United States Patent
Horscroft et al.

(10) Patent No.: US 11,464,836 B2
(45) Date of Patent: Oct. 11, 2022

(54) RNA FOR TREATMENT OR PROPHYLAXIS OF A LIVER DISEASE

(71) Applicant: CureVac AG, Tübingen (DE)

(72) Inventors: Nigel Horscroft, Tübingen (DE); Marion Pönisch, Tübingen (DE); Christine Weinl-Tenbruck, Tübingen (DE); Frédéric Chevessier-Tünnesen, Tübingen (DE)

(73) Assignee: CureVac AG, Tübingen (DE)

( * ) Notice: Subject to any disclaimer, the term of this patent is extended or adjusted under 35 U.S.C. 154(b) by 0 days.

(21) Appl. No.: 16/466,630

(22) PCT Filed: Dec. 8, 2017

(86) PCT No.: PCT/EP2017/082103
§ 371 (c)(1),
(2) Date: Jun. 4, 2019

(87) PCT Pub. No.: WO2018/104538
PCT Pub. Date: Jun. 14, 2018

(65) Prior Publication Data
US 2019/0343933 A1    Nov. 14, 2019

(30) Foreign Application Priority Data

Dec. 8, 2016    (WO) ................. PCT/EP2016/080315

(51) Int. Cl.
| C07H 21/02 | (2006.01) |
| C07H 21/04 | (2006.01) |
| A61K 38/48 | (2006.01) |
| A61P 1/16 | (2006.01) |
| A61K 38/17 | (2006.01) |
| A61K 38/18 | (2006.01) |
| A61K 38/19 | (2006.01) |
| C12N 15/11 | (2006.01) |

(52) U.S. Cl.
CPC ...... *A61K 38/4886* (2013.01); *A61K 38/1709* (2013.01); *A61K 38/1825* (2013.01); *A61K 38/1833* (2013.01); *A61K 38/191* (2013.01); *A61P 1/16* (2018.01); *C12N 15/11* (2013.01); *C12N 2320/30* (2013.01)

(58) Field of Classification Search
CPC .................................................. C12N 15/113
See application file for complete search history.

(56) References Cited

U.S. PATENT DOCUMENTS

| 2005/0032730 A1 | 2/2005 | von der Mülbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2014/0249209 A1 | 9/2014 | Fox et al. |

(Continued)

FOREIGN PATENT DOCUMENTS

| WO | WO 2013/106510 | 7/2013 |
| WO | WO 2013/143698 | 10/2013 |

(Continued)

OTHER PUBLICATIONS

Ahn et al. (Inflamm Bowel Dis, 14, 7, 2008, 908-920).*
Rhee et al. (The Journal of Biological Chemistry, 281, 21, 2006, 14683-14690).*
Tannoli et al. (Journal of Lipid Research, 45, 2004, 941-947).*
Filippo et al. (Journal of Hepatology, 2014, 61, 891-902).*
Fenton (Design, Synthesis, and Biological Evaluation of Diketopiperazine Based Ionizable Lipids for the In Vivo Delivery of Messenger RNA, Jun. 2016, pp. 1-104).*
Lint et al. (Expert Rev Vaccines, 14(2), 2015, 235-251).*
Rabinovich et al. ((2013) Cell Engineering with Synthetic Messenger RNA. In: Rabinovich P. (eds) Synthetic Messenger RNA and Cell Metabolism Modulation. Methods in Molecular Biology (Methods and Protocols), vol. 969. Humana Press, Totowa, NJ).*
Kariko et al. (Molecular Therapy, 16, 11, 2008, 1833-1840).*

(Continued)

*Primary Examiner* — Amy H Bowman
(74) *Attorney, Agent, or Firm* — Parker Highlander PLLC

(57) ABSTRACT

The present invention relates to an RNA suitable for treatment or prophylaxis of liver diseases. In particular, the present invention provides an RNA encoding at least one peptide or protein selected from the group consisting of an extracellular matrix protease, CCAAT/enhancer-binding protein alpha (CEBPA), TNF-related apoptosis-inducing ligand (TRAIL), Hepatocyte Growth Factor (HGF), hepatocyte nuclear factor 4 alpha (HNF4A), fibroblast growth factor 21 (FGF21), opioid growth factor receptor-like 1 (OGFRL1), Relaxin 1 (RLN1), Relaxin 2 (RLN2) and Relaxin 3 (RLN3), or a fragment or a variant of any of these peptides or proteins. The present invention concerns said RNA as well as compositions and kits comprising the RNA. Furthermore, the present invention relates to the RNA, compositions or kits as disclosed herein for use as a medicament, in particular for treatment or prophylaxis of a liver disease. The present invention also provides the use of the RNA, compositions or kits as disclosed herein for increasing the expression of said encoded protein, in particular in gene therapy.

17 Claims, 4 Drawing Sheets

Figure 1:
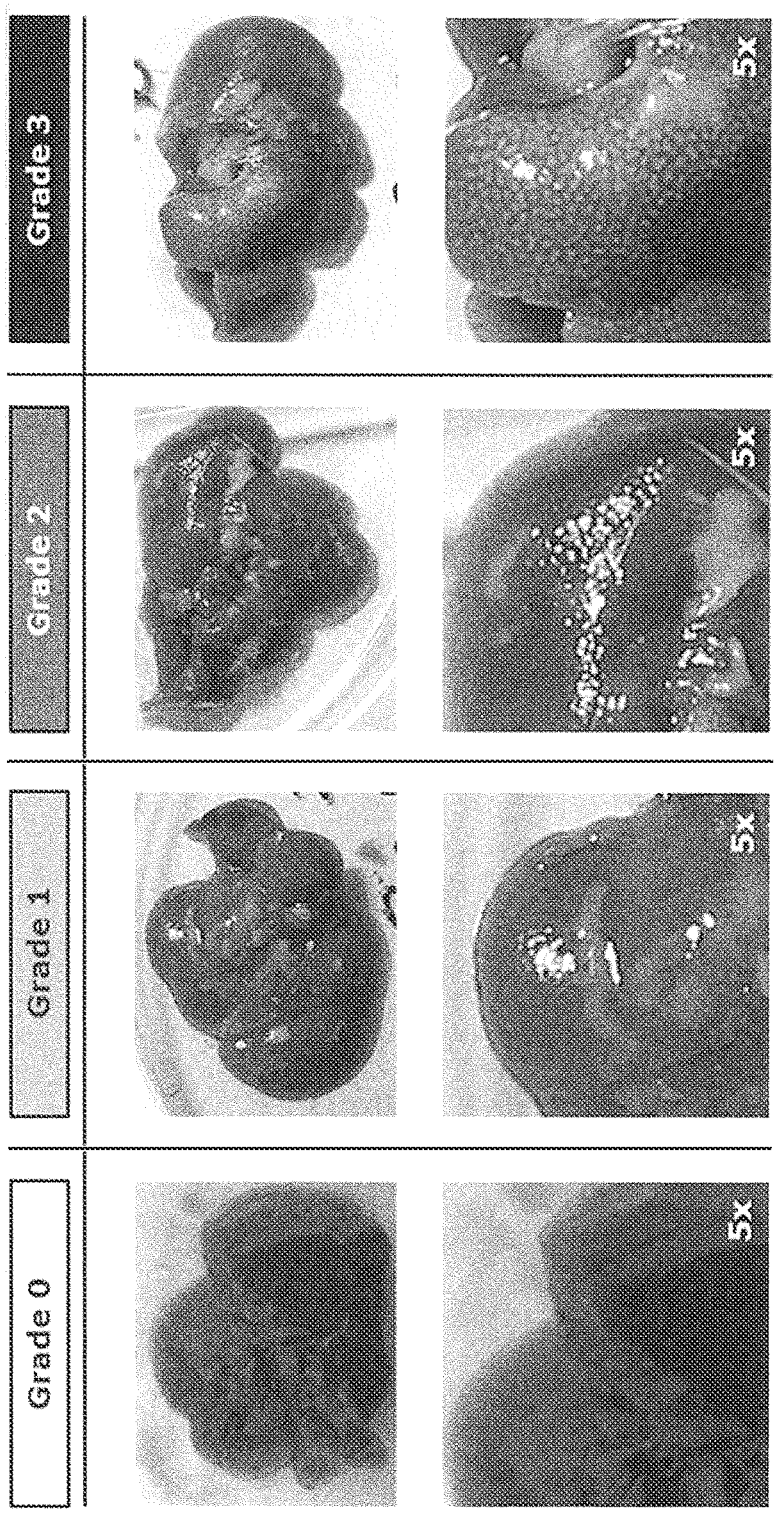

Specification includes a Sequence Listing.

(56) References Cited

U.S. PATENT DOCUMENTS

| | | |
|---|---|---|
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |

FOREIGN PATENT DOCUMENTS

| | | | |
|---|---|---|---|
| WO | WO 2013/143699 | 10/2013 | |
| WO | WO 2013/143700 | 10/2013 | |
| WO | WO 2013/151672 | 10/2013 | |
| WO | WO 2014/039768 | 3/2014 | |
| WO | WO 2014/152540 | 9/2014 | |
| WO | WO 2014/158795 | 10/2014 | |
| WO | WO 2015/024667 | 2/2015 | |
| WO | WO 2015/075557 | 5/2015 | |
| WO | WO 2015/101415 | 7/2015 | |
| WO | WO 2015/117021 | 8/2015 | |
| WO | WO 2015/162422 A1 * | 10/2015 | ........... C12N 15/113 |
| WO | WO 2016/086227 | 6/2016 | |
| WO | WO 2016/091391 | 6/2016 | |
| WO | WO 2016/107877 | 7/2016 | |
| WO | WO 2016/170176 | 10/2016 | |
| WO | WO 2016/170349 | 10/2016 | |
| WO | WO 2017/021546 | 2/2017 | |
| WO | WO 2017/025447 | 2/2017 | |
| WO | WO 2017/064146 | 4/2017 | |
| WO | WO 2017/137095 | 8/2017 | |
| WO | WO 2017/140905 | 8/2017 | |
| WO | WO 2017/182634 | 10/2017 | |
| WO | WO 2017/186928 | 11/2017 | |
| WO | WO 2017/191258 | 11/2017 | |
| WO | WO 2017/191274 | 11/2017 | |
| WO | WO 2017/203008 | 11/2017 | |
| WO | WO 2017/212006 | 12/2017 | |
| WO | WO 2017/212007 | 12/2017 | |
| WO | WO 2017/212008 | 12/2017 | |
| WO | WO 2017/212009 | 12/2017 | |
| WO | WO 2018/078053 | 5/2018 | |
| WO | WO 2018/096179 | 5/2018 | |
| WO | WO 2018/104540 | 6/2018 | |
| WO | WO 2018/115507 | 6/2018 | |
| WO | WO 2018/115525 | 6/2018 | |
| WO | WO 2018/115527 | 6/2018 | |

OTHER PUBLICATIONS

Abe et al., "Effective Prevention of Liver Fibrosis by Liver-targeted Hydrodynamic Gene Delivery of Matrix Metalloproteinase-13 in a Rat Liver Fibrosis Model", *Mol. Ther. Nucleic Acids*, 5:e276, 2016.
Fenton et al., "Bioinspired Alkenyl Amino Alcohol Ionizable Lipid Materials for Highly Potent In Vivo mRNA Delivery", *Adv. Mater.*, 28(15):2939-2943, 2016.
Iimuro et al., "Delivery of matrix metalloproteinase-1 attenuates established liver fibrosis in the rat", *Gastroenterology*, 124(2):445-458, 2003.
International Preliminary Report on Patentability issued in corresponding PCT Application No. PCT/EP2017/082103, dated May 17, 2018.
International Search Report and Written Opinion issued in corresponding PCT Application No. PCT/EP2017/082103, dated May 17, 2018.
Liu et al., "The role of fibroblast growth factor 21 in the pathogenesis of non-alcoholic fatty liver disease and implications for therapy", *Metobolism*, 64(3):380-390, 2015.
Roderfeld, "Inhibition of hepatic fibrogenesis by matrix metalloproteinase-9 mutants in mice", *FASEB J.*, 20(3):444-454, 2006.
Shi et al., "C/EBP[alpha] inhibits hepatocellular carcinoma by reducing Notch3/Hes1/p27 casc", *Digestive Liver Dis.*, 45(10):844-851, 2013.
Siller-López et al., "Treatment with human metalloproteinase-8 gene delivery ameliorates experimental rat liver cirrhosis", *Gastroenterology*, 126(4):1122-1133, 2004.
Simeonov et al., "Direct Reprogramming of Human Fibroblasts to Hepatocyte-Like Cells by Synthetic Modified mRNA", *PLoS One*, 9(6):e100134, 2014.
Yang et al., "Therapeutic HNF4A mRNA attenuates liver fibrosis in a preclinical model," *Journal of Hepatology*, Journal Pre-proof, doi: https://doi.org/10.1016/j.jhep.2021.08.011, 2021.
Ning et al., "Hepatocyte Nuclear Factor 4[alpha] Suppresses the Development of Hepatocellular Carcinoma," *Cancer Research*, 70(19):7640-7651, 2010.

* cited by examiner

RNA FOR TREATMENT OR PROPHYLAXIS OF A LIVER DISEASE

This application is a national phase application under 35 U.S.C. § 371 of International Application No. PCT/EP2017/082103, filed Dec. 8, 2017, which claims benefit of International Application No. PCT/EP2016/080315, filed Dec. 8, 2016, the entire contents of each of which are hereby incorporated by reference.

INTRODUCTION

The present invention relates to an RNA suitable for treatment or prophylaxis of liver diseases. In particular, the present invention provides an RNA encoding at least one peptide or protein selected from the group consisting of an extracellular matrix protease, CCAAT/enhancer-binding protein alpha (CEBPA), TNF-related apoptosis-inducing ligand (TRAIL), hepatocyte nuclear factor 4 alpha (HNF4A), fibroblast growth factor 21 (FGF21), opioid growth factor receptor-like 1 (OGFRL1), Hepatocyte Growth Factor (HGF), Relaxin 1 (RLN1), Relaxin 2 (RLN2) and Relaxin 3 (RLN3), or a fragment or a variant of any of these peptides or proteins. The present invention concerns said RNA as well as compositions and kits comprising the RNA. Furthermore, the present invention relates to the RNA, compositions or kits as disclosed herein for use as a medicament, in particular for treatment or prophylaxis of a liver disease. The present invention also provides the use of the RNA, compositions or kits as disclosed herein for increasing the expression of said encoded protein, in particular in gene therapy.

Liver diseases represent a major health concern worldwide. The major causes of liver injury range from viral diseases and autoimmune diseases over metabolic disorders to malnutrition and alcohol drug abuse and vary greatly in different populations. Irrespective of its cause, however, sustained liver injury leads to a characteristic wound healing response, in which the extracellular matrix (ECM) is remodeled by activation and proliferation of mesenchymal cell populations within the liver. Chronic damage of liver tissue causes a progressive accumulation of deposited extracellular matrix proteins, which encircle the damaged tissue, resulting in severe structural and functional alterations. That process, which is also referred to as fibrosis, can ultimately lead to or contribute to liver cirrhosis, liver failure and liver cancer.

Several therapeutic approaches were designed to stop or reduce the fibrotic response (for review, see Wallace K. et al.: Liver fibrosis. Biochem. J. (2008), 411:1-18). However, at present there is no therapeutic agent indicated and licensed for the primary treatment of liver fibrosis and still, no targeted anti-fibrotic therapy exists at this time. Also for other liver diseases, such as liver cirrhosis, an effective cure is urgently needed.

From the prior art, it is known that systemic administration of e.g. TRAIL or collagenase can lead to adverse effects, e.g. systemic toxicity. Recombinant TRAIL suffers from a short half-life and low potency, the very short half-life of TRAIL requiring large and frequent dosing (see Forero-Torres et al.: Phase I Trial of Weekly Tigatuzumab, an Agonistic Humanized Monoclonal Antibody Targeting Death Receptor 5 (DR5). Cancer Biotherapy & Radiopharmaceuticals 25.1 (2010): 13-19. PMC). Thus it failed to show efficacy in cancer clinical trials.

Likewise, WO2014158795A1 deals with the diagnosis and treatment of fibrosis using using chemically modified vascular endothelial growth factor (VEGF) mRNA for treating fibrosis.

It is thus an object of the present invention to provide a system suitable for use in treatment or prophylaxis of liver diseases, such as liver fibrosis, liver cirrhosis or liver cancer. In particular, it is an object to provide a system for expressing a peptide or protein capable of reducing, ameliorating or curing liver diseases as described herein. It is a further object of the invention to provide such a system, which allows treatment and/or prophylaxis of liver diseases, particularly as defined herein, in a safe and effective manner.

The object underlying the present invention is solved by the claimed subject matter.

The present application is filed together with a sequence listing in electronic format. The information contained in the electronic format of the sequence listing filed together with this application is part of the description of the present application and is incorporated herein by reference in its entirety. Where reference is made herein to a "SEQ ID NO:", the corresponding nucleic acid sequence or amino acid sequence in the sequence listing having the respective identifier is referred to, unless specified otherwise.

DEFINITIONS

For the sake of clarity and readability the following definitions are provided. Any technical feature mentioned for these definitions may be read on each and every embodiment of the invention. Additional definitions and explanations may be specifically provided in the context of these embodiments.

Artificial nucleic acid molecule: An artificial nucleic acid molecule may typically be understood to be a nucleic acid molecule, e.g. a DNA or an RNA that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides, which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context, an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bicistronic RNA, multicistronic RNA: A bicistronic or multicistronic RNA is typically an RNA, preferably an mRNA, that typically may have two (bicistronic) or more (multicistronic) open reading frames (ORF). An open reading frame in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated with its cargo by covalent or non-covalent interaction. A carrier may transport nucleic acids, e.g. RNA or DNA, to the target cells. The carrier may—for some embodiments—be a cationic component.

Cationic component: The term "cationic component" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein, which is positively charged under physiological conditions, particularly under physiological conditions in vivo. A "cationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the conditions given.

5'-car: A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety.

DNA: DNA is the usual abbreviation for deoxyribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and G/C-base-pairing.

Fragment of a sequence: A fragment of a sequence may typically be a shorter portion of a full-length sequence of e.g. a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) molecule, from which the fragment is derived.

G/C modified: A G/C-modified nucleic acid may typically be a nucleic acid, preferably an artificial nucleic acid molecule as defined herein, based on a modified wild type sequence comprising a preferably increased number of guanosine and/or cytosine nucleotides as compared to the wild type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule. As used herein, the term "G/C modification" comprises, in particular, the modifications of the number of guanosine and/or cytosine nucleotides in the RNA according to the invention, such as GC optimization of sequences, adaptation of sequences to human codon usage, codon optimization, or C-optimization of sequences.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an RNA as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient. The term "gene therapy" as used herein typically comprises treatment as well as prevention or prophylaxis of a disease.

Heterologous sequence: Two sequences are typically understood to be "heterologous" if they are not derivable from the same gene. I.e., although heterologous sequences may be derivable from the same organism, they naturally (in nature) do not occur in the same nucleic acid molecule, such as in the same mRNA.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term "nucleic acid molecule" preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (ORF) in the context of the invention may typically be a sequence of several nucleotide triplets, which may be translated into a peptide or protein. An open reading frame preferably contains a start codon, i.e. a combination of three subsequent nucleotides coding usually for the amino acid methionine (ATG), at its 5'-end and a subsequent region, which usually exhibits a length which is a multiple of 3 nucleotides. An ORF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The open reading frame may be isolated or it may be incorporated in a longer nucleic acid sequence, for example in a vector or an mRNA. An open reading frame may also be termed "(protein) coding region" or, preferably, "coding sequence".

Peptide: A peptide or polypeptide is typically a polymer of amino acid monomers, linked by peptide bonds. It typically contains less than 50 monomer units. Nevertheless, the term "peptide" is not a disclaimer for molecules having more than 50 monomer units. Long peptides are also called polypeptides, typically having between 50 and 600 monomeric units.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein: A protein typically comprises one or more peptides or polypeptides. A protein is typically folded into 3-dimensional form, which may be required for the protein to exert its biological function.

Poly(A) sequence: A poly(A) sequence, also called poly(A)tail or 3'-poly(A)tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. As used herein, a poly(A) sequence may also comprise about 10 to 200 adenosine nucleotides, preferably about 10 to 100 adenosine nucleotides, more preferably about 40 to 80 adenosine nucleotides or even more preferably about 50 to 70 adenosine nucleotides. A poly(A) sequence is typically located at the 3'-end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector.

Polyadenylation: Polyadenylation is typically understood to be the addition of a poly(A) sequence to a nucleic acid molecule, such as an RNA molecule, e.g. to a premature mRNA. Polyadenylation may be induced by a so-called polyadenylation signal. This signal is preferably located within a stretch of nucleotides at the 3'-end of a nucleic acid molecule, such as an RNA molecule, to be polyadenylated.

A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, an open reading frame, a 3'-UTR and a poly(A) sequence. Aside from messenger RNA, several non-coding types of RNA exist which may be involved in regulation of transcription and/or translation.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. In other words, in the context of the present invention, identity of sequences preferably relates to the percentage of nucleotides of a sequence which have the same position in two or more sequences having the same length. Gaps are usually regarded as non-identical positions, irrespective of their actual position in an alignment.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid, which is suitable for storing, transporting, and/or administering a pharmaceutically active compound.

3'-untranslated region (3'-UTR): Generally, the term "3'-UTR" refers to a part of the artificial nucleic acid molecule, which is located 3' (i.e. "downstream") of an open reading frame and which is not translated into protein. Typically, a 3'-UTR is the part of an mRNA which is located between the protein coding region (open reading frame (ORF) or coding sequence (CDS)) and the poly(A) sequence of the mRNA. In the context of the invention, the term "3'-UTR" may also comprise elements, which are not encoded in the template, from which an RNA is transcribed, but which are added after transcription during maturation, e.g. a poly(A) sequence. A 3'-UTR of the mRNA is not translated into an amino acid sequence. The 3'-UTR sequence is generally encoded by the gene, which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-capping, splicing the pre-mature mRNA to excise optional introns and modifications of the 3'-end, such as polyadenylation of the 3'-end of the pre-mature mRNA and optional endo-/or exonuclease cleavages etc. In the context of the present invention, a 3'-UTR corresponds to the sequence of a mature mRNA, which is located between the stop codon of the protein coding region, preferably immediately 3' to the stop codon of the protein coding region, and the poly(A) sequence of the mRNA. The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites. The 5'-UTR may be post-transcriptionally modified, for example by addition of a 5'-cap. In the context of the present invention, a 5'-UTR corresponds to the sequence of a mature mRNA, which is located between the 5'-cap and the start codon. Preferably, the 5'-UTR corresponds to the sequence, which extends from a nucleotide located 3' to the 5'-cap, preferably from the nucleotide located immediately 3' to the 5'-cap, to a nucleotide located 5' to the start codon of the protein coding region, preferably to the nucleotide located immediately 5' to the start codon of the protein coding region. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR. By the inventive embodiments such a 5'-UTR may be provided 5'-terminal to the coding sequence. Its length is typically less than 500, 400, 300, 250 or less than 200 nucleotides. In other embodiments its length may be in the range of at least 10, 20, 30 or 40, preferably up to 100 or 150, nucleotides.

5'-Terminal Oligopyrimidine Tract (TOP): The 5'-terminal oligopyrimidine tract (TOP) is typically a stretch of pyrimidine nucleotides located in the 5'-terminal region of a nucleic acid molecule, such as the 5'-terminal region of certain mRNA molecules or the 5'-terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5'TOP ends one nucleotide 5' to the first purine nucleotide located downstream of the TOP. Messenger RNA that contains a 5'-terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purin residue in said gene or mRNA. A TOP motif in the sense of the present invention is preferably located at the 5'-end of a sequence, which represents a 5'-UTR, or at the 5'-end of a sequence, which codes for a 5'-UTR. Thus, preferably, a stretch of 3 or more pyrimidine nucleotides is called "TOP motif" in the sense of the present invention if this stretch is located at the 5'-end of a respective sequence, such as the artificial nucleic acid molecule, the 5'-UTR element of the artificial nucleic acid molecule, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

TOP gene: TOP genes are typically characterised by the presence of a 5'-terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-cap to the nucleotide located 5" to the start codon. A 5'-UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID NOs: 1-1363 of the patent application WO2013/143700, whose disclosure is incorporated herewith by reference. In this context, a particularly preferred fragment of a 5'-UTR of a TOP gene is a 5'-UTR of a TOP gene lacking the 5'TOP motif. The terms "5'-UTR of a TOP gene" or "5'TOP-UTR" preferably refer to the 5'-UTR of a naturally occurring TOP gene.

DETAILED DESCRIPTION OF THE INVENTION

The present invention relates to a novel RNA and to compositions and kits comprising the RNA. Furthermore, several uses, in particular medical uses, of the RNA according to the invention and of the compositions and kits are provided.

In a first aspect, the present invention relates to an RNA comprising at least one coding sequence encoding at least one peptide or protein comprising or consisting of a peptide or protein selected from the group consisting of an extracellular matrix protease or human collagenase MMP1, Hepatocyte Growth Factor (HGF), CCAAT/enhancer-binding protein alpha (CEBPA), TNF-related apoptosis-inducing ligand (TRAIL), hepatocyte nuclear factor 4 alpha (HNF4A), fibroblast growth factor 21 (FGF21), opioid growth factor receptor-like 1 (OGFRL1), clostridial type II collagenase, Relaxin 1 (RLN1), Relaxin 2 (RLN2) and Relaxin 3 (RLN3), or a fragment or a variant of any of these peptides or proteins.

The RNA according to the invention is preferably suitable for use in the treatment or prophylaxis of a liver disease or a liver disorder as described herein, preferably selected from liver fibrosis and liver cirrhosis. More preferably, the RNA according to the present invention is preferably suitable for use in safe and effective treatment or prophylaxis of a liver disease as described herein in mammals, preferably in human.

Accordingly, in a second aspect, the present invention the present invention provides the RNA as described herein for use in the treatment or prophylaxis of a liver disease. Moreover, the RNA as described herein is preferably provided for gene therapy.

In the following, the RNA according to the invention is described. The disclosure concerning the inventive RNA as such also applies to the RNA for (medical) use as described herein as well as to the RNA in the context of the (pharmaceutical) composition or the RNA in the context of the kit (of parts) comprising the RNA according to the invention. In particular, when referring to an "RNA according to the invention", the present disclosure also relates to an "RNA for use according to the invention" and vice versa.

The inventors surprisingly found that the RNA according to the invention is capable of providing sufficient expression of the peptide or protein encoded in the at least one coding region, e.g. upon administration of the RNA to a mammalian subject, in particular in liver tissue. Expression levels of the peptide or protein can surprisingly be obtained by using the RNA of the invention which are increased in comparison with the expression levels obtained by using a reference construct known in the art encoding the respective peptide or protein. Advantageously, the peptide or protein encoded by the RNA can thus exert its effects, which are preferably exploited in treatment or prophylaxis of a liver disease, in particular in the liver of a mammalian subject, preferably without or with acceptable side-effects. In preferred embodiments, the expression level of the encoded peptide or protein is sufficiently high in liver in order to exert its effect in liver and lower in other organs, in order to reduce side-effects.

In the context of the present invention, the at least one coding sequence of the RNA according to the invention preferably comprises a nucleic acid sequence encoding a peptide or protein comprising or consisting of a peptide or protein as defined herein. In some embodiments, a peptide or protein substantially comprises the entire amino acid sequence of the reference peptide or protein, such as the naturally occurring peptide or protein (e.g. matrix metalloproteinase-1 or TNF-related apoptosis-inducing ligand (TRAIL)). The term "full-length peptide or protein" as used herein may refer to naturally occurring peptides or proteins, such as a peptide or protein comprising or consisting of an amino acid sequence selected from any one of the amino acid sequences defined by database accession number NP_003801.1, P50591, NP_036656.1, P05554, NP_031704.2, P53566, NP_004355.2, P49715, NP_000448.3, P41235, NP_061986.1, Q9NSA1, NP_078852.3, Q5TC84, NP_008842.1, P04808, NP_604390.1, P04090, NP_543140.1, Q8WXF3, NP_002412.1, P03956, BAA77453.1, BAA34542.1 and BAA34542.1, or by SEQ ID NO: 4, 8, 10, 12, 14 to 19, 20, 22, 25 and 26. In addition, the term may also refer to a peptide or protein comprising or consisting of an amino acid sequence selected from the group consisting of SEQ ID NO: 5 to 7, 9, 11, 13, 21, 23, 24, 27 and 28. Furthermore, the term may also refer to an amino acid sequence encoded by any one of the nucleic acid sequences defined by the database accession numbers NM_003810.3, CCDS3219.1, ENSG00000121858, NM_012524.3, NM_007678.3, CCDS21145.1, NM_004364.4, CCDS54243, M37197, ENSG00000245848, NM_000457.4, CCDS13330.1, X76930, ENSG00000101076, NM_019113.3, CCDS12734.1, AB021975, ENSG00000105550, NM_024576.4, CCDS34482.1, ENSG00000119900, NM_006911.3, CCDS6462, ENSG00000107018, NM_134441.2, NM_080864.3, NM_001311197, CCDS12302.1, AF447451, ENSG00000171136, NM_002421.3, CCDS8322.1, X54925, ENSG00000196611, D87215.1, AB014075.1 and AB014075.

According to a preferred embodiment, the at least one coding sequence of the RNA according to the invention encodes a peptide or protein comprising or consisting of an amino acid sequence selected from any one of the amino acid sequences defined by database accession numbers NP_003801.1, P50591, NP_036656.1, P05554, NP_031704.2, P53566, NP_004355.2, P49715, NP_000448.3, P41235, NP_061986.1, Q9NSA1, NP_078852.3, Q5TC84, NP_008842.1, P04808, NP_604390.1, P04090, NP_543140.1, Q8WXF3, NP_002412.1, P03956, BAA77453.1, BAA34542.1 and BAA34542.1, or a fragment or variant of any one of these amino acid sequences. More preferably, the encoded peptide or protein comprises or consists of an amino acid sequence encoded by any one of the nucleic acid sequences defined by the database accession numbers NM_003810.3, CCDS3219.1, ENSG00000121858, NM_012524.3, NM_007678.3, CCDS21145.1, NM_004364.4, CCDS54243, M37197, ENSG00000245848, NM_000457.4, CCDS13330.1, X76930, ENSG00000101076, NM_019113.3, CCDS12734.1, A8021975, ENSG00000105550, NM_024576.4, CCDS34482.1, ENSG00000119900, NM_006911.3, CCDS6462, ENSG00000107018, NM_134441.2, CCDS6460.1, ENSG00000107014, NM_080864.3, NM_001311197, CCDS12302.1, AF447451, ENSG00000171136, NM_002421.3, CCDS8322.1, X54925, ENSG00000196611, D87215.1, AB014075.1 and A8014075, or a fragment or a variant of any one of these nucleic acid sequences. Even more preferably, the encoded peptide or protein comprises or consists of an amino acid sequence selected from the group consisting of SEQ ID NO: 4 to SEQ ID NO: 28, or a fragment or variant of any one of these amino acid sequences.

Alternatively, the at least one coding sequence of the RNA according to the invention may also comprise a nucleic acid sequence encoding a peptide or protein comprising or consisting of a fragment of a peptide or protein or a fragment of a variant of a peptide or protein as defined herein.

In the context of the present invention, a "fragment" of a peptide or protein or of a variant thereof may comprise a sequence of a peptide or protein or of a variant thereof as defined above, which is, with regard to its amino acid sequence (or its encoded nucleic acid sequence), N-terminally, C-terminally and/or intrasequentially truncated compared to the reference amino acid sequence, such as the amino acid sequence of the naturally occurring protein or a variant thereof (or its encoded nucleic acid sequence). Such truncation may occur either on the amino acid level or on the nucleic acid level, respectively. A sequence identity with respect to such a fragment as defined herein therefore preferably refers to the entire peptide or protein or a variant thereof as defined herein or to the entire (coding) nucleic acid sequence of such a peptide or protein or of a variant thereof.

According to some embodiments of the invention, the RNA comprises at least one coding sequence encoding a peptide or protein comprising or consisting of a variant of a peptide or protein as defined herein, or a fragment of a variant of a peptide or protein.

In certain embodiments of the present invention, a "variant" of a peptide or protein or a fragment thereof as defined herein may be encoded by the RNA comprising at least one coding sequence as defined herein, wherein the amino acid sequence encoded by the at least one coding sequence differs in at least one amino acid residue from the reference amino acid sequence, such as a naturally occurring amino acid sequence. In this context, the "change" in at least one amino acid residue may consist, for example, in a mutation of an amino acid residue to another amino acid, a deletion or an insertion. More preferably, the term "variant" as used in the context of the amino acid sequence encoded by the at least one coding sequence of the RNA according to the invention comprises any homolog, isoform or transcript variant of a peptide or protein or a fragment thereof as defined herein, wherein the homolog, isoform or transcript variant is preferably characterized by a degree of identity or homology, respectively, as defined herein.

In the context of the present invention, a "fragment" or a "variant" of a protein or peptide may have at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% amino acid identity over a stretch of at least 10, at least 20, at least 30, at least 50, at least 75 or at least 100 amino acids of such protein or peptide. More preferably, a "fragment" or a "variant" of a protein or peptide as used herein is at least 40%, preferably at least 50%, more preferably at least 60%, more preferably at least 70%, even more preferably at least 80%, even more preferably at least 90%, most preferably at least 95% identical to the protein or peptide, from which the variant is derived.

Preferably, a variant of a peptide or protein or a fragment thereof may be encoded by the RNA comprising at least one coding sequence as defined herein, wherein at least one amino acid residue of the amino acid sequence encoded by the at least one coding sequence is substituted. Substitutions, wherein amino acids, which originate from the same class, are exchanged for one another, are called conservative substitutions. In particular, these are amino acids having aliphatic side chains, positively or negatively charged side chains, aromatic groups in the side chains or amino acids, the side chains of which can form hydrogen bridges, e.g. side chains which have a hydroxyl function. By conservative constitution, e.g. an amino acid having a polar side chain may be replaced by another amino acid having a corresponding polar side chain, or, for example, an amino acid characterized by a hydrophobic side chain may be substituted by another amino acid having a corresponding hydrophobic side chain (e.g. serine (threonine) by threonine (serine) or leucine (isoleucine) by isoleucine (leucine)). In a preferred embodiment, a variant of a peptide or protein or a fragment thereof may be encoded by the RNA according to the invention, wherein at least one amino acid residue of the amino acid sequence encoded by the at least one coding sequence comprises at least one conservative substitution compared to a reference sequence, such as the respective naturally occurring sequence. These amino acid sequences as well as their encoding nucleic acid sequences in particular are comprised by the term "variant" as defined herein.

Insertions, deletions and/or non-conservative substitutions are also possible, in particular, at those sequence positions, which preferably do not cause a substantial modification of the three-dimensional structure. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam).

In order to determine the percentage, to which two sequences (nucleic acid sequences, e.g. RNA or mRNA sequences as defined herein, or amino acid sequences, preferably the amino acid sequence encoded by the RNA according to the invention) are identical, the sequences can be aligned in order to be subsequently compared to one another. For this purpose, e.g. gaps can be inserted into the sequence of the first sequence and the component at the corresponding position of the second sequence can be compared. If a position in the first sequence is occupied by the same component as is the case at a corresponding position in the second sequence, the two sequences are identical at this position. The percentage, to which two sequences are identical, is a function of the number of identical positions divided by the total number of positions. The percentage, to which two sequences are identical, can be determined using a mathematical algorithm. A preferred, but not limiting, example of a mathematical algorithm, which can be used is the algorithm of Karlin et al. (1993), PNAS USA, 90:5873-5877 or Altschul et al. (1997), Nucleic Acids Res., 25:3389-3402. Such an algorithm is integrated, for example, in the BLAST program. Sequences, which are identical to the sequences of the present invention to a certain extent, can be identified by this program.

In the context of the present invention, a fragment of a peptide or protein or a variant thereof encoded by the at least one coding sequence of the RNA according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a reference amino acid sequence, preferably with the amino acid sequence of the respective naturally occurring full-length peptide or protein or a variant thereof.

More preferably, a fragment of a peptide or protein or a variant thereof encoded by the at least one coding sequence of the RNA according to the invention typically comprises or consists of an amino acid sequence having a sequence identity of at least 80% with any one of the reference amino acid sequences defined by database accession numbers NP_003801.1, P50591, NP_036656.1, P05554, NP_031704.2, P53566, NP_004355.2, P49715, NP_000448.3, P41235, NP_061986.1, Q9NSA1, NP_078852.3, Q5TC84, NP_008842.1, P04808, NP_604390.1, P04090, NP_543140.1, Q8WXF3, NP_002412.1, P03956, BAA77453.1, BAA34542.1 and BAA34542.1, or a fragment or variant of any of these peptides or proteins. Most preferably, the encoded peptide or protein comprises or consists of an amino acid sequence having a sequence identity of at least 80% with any one of the reference amino acid sequences selected from the group consisting of SEQ ID NO: 4 to SEQ ID NO: 28, or a fragment or variant of any one of these sequences.

Preferably, the at least one coding sequence of the RNA, which encodes the at least one peptide or protein as defined herein, comprises or consists of a nucleic acid sequence selected from the group consisting of SEQ ID NO: 32 to 71, 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of these nucleic acid sequences. As used herein, a nucleic acid sequence comprising or consisting of a nucleic acid sequence selected from the group consisting of SEQ ID NO: 32 to 71, 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407 may also be referred to as "full-length nucleic acid (sequence)".

In certain embodiments, the RNA according to the invention, preferably the at least one coding sequence of the RNA according to the invention, may comprise or consist of a fragment of a nucleic acid sequence encoding a peptide or protein or a fragment or variant thereof as defined herein. Preferably, the at least one coding sequence of the RNA according to the invention comprises or consists of a fragment, preferably as defined herein, of any one of the nucleic acid sequences according to SEQ ID NO: 32 to 71, 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a variant of any one of these sequences.

In this context, a "fragment of a nucleic acid (sequence)" is preferably a nucleic acid sequence encoding a fragment of a peptide or protein or of a variant thereof as described herein. More preferably, the expression "fragment of a nucleic acid sequence" refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a respective full-length nucleic acid sequence, preferably with a nucleic acid sequence selected from the group consisting of SEQ ID NO: 32-71, 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a variant of any of these nucleic acid sequences.

In another preferred embodiment, the RNA according to the invention, preferably the at least one coding sequence of the RNA according to the invention, may comprise or consist of a variant of a nucleic acid sequence as defined herein, preferably of a nucleic acid sequence encoding a peptide or protein or a fragment thereof as defined herein.

The expression "variant of a nucleic acid sequence" as used herein in the context of a nucleic acid sequence encoding a peptide or protein as described herein or a fragment thereof, typically refers to a nucleic acid sequence, which differs by at least one nucleic acid residue from the respective reference nucleic acid sequence, for example from the respective naturally occurring nucleic acid sequence or from a full-length nucleic acid sequence as defined herein, or from a fragment thereof. More preferably, the expression "variant of a nucleic acid sequence" as used in the context of the present invention refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

Preferably, the RNA according to the invention, more preferably the at least one coding sequence of the RNA according to the invention, encodes a variant of a peptide or protein or a fragment thereof, preferably as defined herein.

In a preferred embodiment, the RNA according to the invention, more preferably the at least one coding sequence of the RNA according to the invention, comprises or consists of a variant of a nucleic acid sequence encoding a peptide or protein or a fragment thereof as defined herein, wherein the variant of the nucleic acid sequence encodes an amino acid sequence comprising at least one conservative substitution of an amino acid residue.

In another embodiment, the RNA according to the invention, more preferably the at least one coding sequence of the RNA according to the invention, comprises or consists of a variant of a nucleic acid sequence encoding a peptide or protein or a fragment thereof as defined herein, wherein the nucleic acid sequence of the variant differs from a reference nucleic acid sequence, preferably from the respective naturally occurring nucleic acid sequence in at least one nucleic acid residue, more preferably without resulting—due to the degenerated genetic code—in an alteration of the encoded amino acid sequence, i.e. the amino acid sequence encoded by the variant or at least part thereof may preferably not differ from the naturally occurring amino acid sequence in one or more mutation(s) within the above meaning.

Furthermore, a "variant" of a nucleic acid sequence encoding a peptide or protein or a fragment or variant thereof as defined herein, may also comprise DNA sequences, which correspond to RNA sequences as defined herein and may also comprise further RNA sequences, which correspond to DNA sequences as defined herein. Those skilled in the art are familiar with the translation of an RNA sequence into a DNA sequence (or vice versa) or with the creation of the complementary strand sequence (i.e. by substitution of U residues with T residues and/or by constructing the complementary strand with respect to a given sequence).

According to a preferred embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a reference nucleic acid sequence, preferably with a nucleic acid sequence encoding a naturally occurring full-length peptide or protein, or a variant thereof, or with a full-length peptide or protein as defined herein, or a variant thereof.

In a further preferred embodiment, the at least one coding sequence of the RNA according to the invention comprises or consists of a nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 32-71, 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of these nucleic acid sequences.

According to a further preferred embodiment, the at least one coding sequence of the RNA according to the invention comprises or consists of a nucleic acid sequence identical to or at least 80% identical to a nucleic acid sequence selected from the group consisting of SEQ ID NO: 36, 37, 75, 77, 78, 91-95 and 97-99, or a fragment or variant of any one of these nucleic acid sequences.

In another embodiment, the at least one coding sequence of the RNA according to the invention comprises or consists of a nucleic acid sequence identical to or at least 80% identical to a nucleic acid sequence selected from the group consisting of SEQ ID NO: 75, 77, 78, 91-95 and 97-99, or a fragment or variant of any one of these nucleic acid sequences.

According to a preferred embodiment, the present invention provides an RNA comprising at least one coding sequence, wherein the at least one coding sequence of the RNA encodes at least one peptide or protein comprising or consisting of an extracellular matrix (ECM) protease, or a fragment or variant thereof. The present invention further provides an RNA comprising at least one coding sequence, wherein the coding sequence encodes at least one peptide or protein comprising or consisting of an extracellular matrix (ECM) protease, or a fragment or variant thereof, for use in the treatment or prophylaxis of a liver disease as described herein, wherein the liver disease is preferably selected from liver fibrosis and liver cirrhosis.

In the context of the present invention, the term "extracellular matrix protease" refers to an enzyme capable of catalyzing the degradation of extracellular matrix protein, preferably in liver tissue. As used herein, an "extracellular matrix protein" is preferably any type of extracellular matrix protein in liver tissue, more preferably a collagen, even more preferably selected from an interstitial collagen and a basement membrane collagen, most preferably selected from a type I, type III and type IV collagen. The term "extracellular matrix protease" as used herein preferably refers to collagenases, more preferably to bacterial collagenases or mammalian matrix metalloproteinases (also referred to herein as "mammalian collagenases") as described herein. Examples of bacterial collagenase include clostridial collagenases, more preferably a clostridial type II collagenase, most preferably a type H collagenase from *Clostridium histolyticum* (such as ColG or ColH). An exemplary mammalian matrix metalloproteinase is, for instance, human matrix metalloproteinase-1.

Extracellular matrix proteases, such as bacterial or mammalian collagenases, are typically expressed as precursor protein, which is usually inactive. Said precursor protein can be activated by cellular enzymes, which remove a regulatory domain, e.g. by proteolytic cleavage at a determined cleavage site. According to a preferred embodiment of the present invention, the at least one coding sequence of the RNA encodes at least one peptide or protein comprising or consisting a collagenase, preferably a bacterial collagenase or a mammalian matrix metalloproteinase, or a fragment or variant thereof, lacking said regulatory domain. Collagenases lacking the regulatory domain are preferably active upon expression, even without prior activation.

In one embodiment, the at least one coding sequence of the RNA according to the invention encodes at least one peptide or protein comprising or consisting of an amino acid sequence identical to or at least 80% identical to an amino acid sequence selected from the group consisting of SEQ ID NO: 20-28, or a fragment or variant of any one of said amino acid sequences.

In a preferred embodiment, the at least one coding sequence of the RNA according to the invention encodes at least one peptide or protein comprising or consisting of a mammalian matrix metalloproteinase, preferably matrix metalloproteinase-1, more preferably human matrix metalloproteinase-1, or a fragment or variant thereof.

As used herein, the term "human matrix metalloproteinase-1" may be abbreviated as, for example, "MMP1" and typically refers to a peptide or protein comprising or consisting of an amino acid sequence identical or at least 80% identical to any one of the amino acid sequences as defined by database accession numbers NP_002412.1 or P03956, or a homolog, fragment or variant of any one of these sequences. Preferably, the term may also refer to an amino acid sequence as encoded by a nucleic acid sequence identical or at least 80% identical to any one of the nucleic acid sequences as defined by database accession numbers NM_002421.3, CCDS8322.1, X54925 or ENSG00000196611, or a homolog, fragment or variant of any one of these sequences. Moreover, the term as used herein may also refer to a peptide or protein comprising or consisting of an amino acid sequence identical or at least 80% identical to an amino acid sequence selected from SEQ ID NO: 20 or 21, or a homolog, fragment or variant of any one of said amino acid sequences.

In certain embodiments, the at least one coding sequence of the RNA according to the invention encodes at least one peptide or protein comprising or consisting of a mammalian matrix metalloproteinase, wherein the peptide or protein comprises or consists of an amino acid sequence identical to or at least 80% identical to SEQ ID NO: 20 or 21, or a fragment or variant of any one of these amino acid sequences. According to a preferred embodiment, the encoded peptide or protein comprises or consists of an amino acid sequence identical to or at least 80% identical to SEQ ID NO: 21, or a fragment or variant thereof. Therein, the at least one coding sequence of the RNA preferably comprises or consists of a nucleic acid sequence identical or at least 80% identical to a nucleic acid sequence selected from the group consisting of SEQ ID NO: 55, 56, 57, 91, 92, 119, 120, 147, 148, 175, 176, 203, 204, 231, 232, 259, 260, 287, 288, 315, 316, 343, 344, 371, 372, 399 and 400, or a fragment or variant of any one of these nucleic acid sequences.

In an alternative embodiment, the at least one coding sequence of the RNA according to the invention encodes at least one peptide or protein comprising or consisting of a bacterial collagenase, preferably a clostridial collagenase, more preferably a clostridial type II collagenase, most preferably a type II collagenase from *Clostridium histolyticum*, or a fragment or variant thereof. It is particularly preferred that the encoded peptide or protein comprises or consists of ColG or ColH from *Clostridium histolyticum*.

As used herein, the term "ColG" typically refers to a peptide or protein comprising or consisting of an amino acid sequence identical to or at least 80% identical to the amino acid sequence as defined by database accession number BAA77453.1, or a homolog, fragment or variant thereof. Preferably, the term may also refer to an amino acid sequence as encoded by a nucleic acid sequence identical to or at least 80% identical to the nucleic acid sequence as defined by database accession number D87215.1, or a homolog, fragment or variant thereof. Moreover, the term as used herein may also refer to a peptide or protein comprising or consisting of an amino acid sequence identical to or at least 80% identical to an amino acid sequence selected from the group consisting of SEQ ID NO: 22-24, or a homolog, fragment or variant of any one of said amino acid sequences.

In the context of the present invention, the term "ColH" typically refers to a peptide or protein comprising or consisting of an amino acid sequence identical or at least 80% identical to the amino acid sequence as defined by database accession number BAA34542.1, or a homolog, fragment or variant thereof. Preferably, the term may also refer to an amino acid sequence as encoded by a nucleic acid sequence identical to or at least 80% identical to the nucleic acid sequence as defined by database accession number AB014075.1, or a homolog, fragment or variant thereof. Moreover, the term as used herein may also refer to a peptide or protein comprising or consisting of an amino acid sequence identical to or at least 80% identical to an amino acid sequence selected from the group consisting of SEQ ID NO: 25-28, or a homolog, fragment or variant of any one of said amino acid sequences.

As mentioned above, collagenases are typically expressed as precursor proteins. Usually, the collagenase precursor protein is cleaved by cellular proteases. However, as the cleavage sites in bacterial collagenases, such as ColG and ColH, are of bacterial origin, eukaryotic proteases may in some cases not effectively cleave the precursor protein. Furthermore, cleavage can be inefficient when recombinant collagenase is expressed at high levels. In preferred embodiments, the at least one coding sequence of the RNA encodes at least one peptide or protein comprising or consisting of a bacterial collagenase as described herein, wherein the bacterial collagenase comprises a cleavage site, preferably a furin cleavage site. More preferably, the at least one coding sequence of the RNA encodes at least one peptide or protein comprising an amino acid sequence identical to or at least 80% identical to the amino acid sequence according to SEQ ID NO: 3; or a fragment or variant thereof. In a preferred embodiment, the at least one coding sequence of the RNA comprises a nucleic acid sequence identical to or at least 80% identical to a nucleic acid sequence selected from the group consisting of SEQ ID NO: 31, 74, 102, 130, 158, 186, 214, 242, 270, 298, 326, 354 and 382, or a fragment or variant thereof. In a preferred embodiment, the presence of said cleavage site advantageously enhances the maturation process of bacterial collagenases, such as ColG and ColH, in eukaryotic cells.

In some embodiments, the at least one coding sequence of the RNA according to the invention encodes at least one peptide or protein comprising or consisting of a ColG, wherein the peptide or protein comprises or consists of an amino acid sequence identical to or at least 80% identical to an amino acid sequence selected from the group consisting of SEQ ID NO: 22-24, or a fragment or variant of any one of these amino acid sequences. Therein, the at least one coding sequence of the RNA preferably comprises or consists of a nucleic acid sequence identical to or at least 80% identical to a nucleic acid sequence selected from the group consisting of SEQ ID NO: 58, 59, 60, 61, 62, 63, 93, 94, 95, 121, 122, 123, 149, 150, 151, 177, 178, 179, 205, 206, 207, 233, 234, 235, 261, 262, 263, 289, 290, 291, 317, 318, 319, 345, 346, 347, 373, 374, 375, 401, 402 and 403, or a fragment or variant of any one of these nucleic acid sequences.

According to a further embodiment, the at least one coding sequence of the RNA according to the invention encodes at least one peptide or protein comprising or consisting of a ColH, wherein the peptide or protein comprises or consists of an amino acid sequence identical to or at least 80% identical to an amino acid sequence selected from the group consisting of SEQ ID NO: 25-28, or a fragment or variant of any one of these amino acid sequences. Therein, the at least one coding sequence of the RNA preferably comprises or consists of a nucleic acid sequence identical to or at least 80% identical to a nucleic acid sequence selected from the group consisting of SEQ ID NO: 64, 65, 66, 67, 68, 69, 70, 71, 96, 97, 98, 99, 124, 125, 126, 127, 152, 153, 154, 155, 180, 181, 182, 183, 208, 209, 210, 211, 236, 237, 238, 239, 264, 265, 266, 267, 292, 293, 294, 295, 320, 321, 322, 323, 348, 349, 350, 351, 376, 377, 378, 379, 404, 405, 406 and 407, or a fragment or variant of any one of these nucleic acid sequences.

In some embodiments, the at least one coding sequence of the RNA according to the invention encodes at least one peptide or protein comprising a bacterial collagenase as defined herein, preferably ColG or ColH, wherein the peptide or protein comprises a signal peptide, preferably a heterologous signal peptide. As used herein, the term "heterologous" refers to a nucleic acid sequence or an amino acid sequence derived from another gene. Hence, the heterologous signal peptide is preferably not derived from a collagenase gene, more preferably not from a bacterial collagenase gene, even more preferably not from a clostridial collagenase gene.

Preferably, the signal peptide as described herein is fused to the N-terminus of a bacterial collagenase gene. In some embodiments, the bacterial collagenase gene may be modified in order to replace an original (wild type) signal peptide with a heterologous signal peptide as described herein. In another embodiment, a Furin cleavage site as described herein is introduced 3' (C-terminally) of the signal peptide, so as to allow removal of the signal peptide by cleavage.

In preferred embodiments, the at least one coding sequence of the RNA according to the invention encodes at least one peptide or protein comprising an amino acid sequence identical to or at least 80% identical to an amino acid sequence selected from the group consisting of SEQ ID NO: 1 and 1455 to 1468, or a fragment or variant of any one of these amino acid sequences. Preferably, the at least one coding sequence of the RNA according to the invention preferably comprises a nucleic acid sequence identical to or at least 80% identical to a nucleic acid sequence selected from the group consisting of SEQ ID NO: 29, 72, 100, 128, 156, 184, 212, 240, 268, 296, 324, 352, 380, 489 and 1469-1650, or a fragment or variant of any one of these nucleic acid sequences.

More preferably, the at least one coding sequence of the RNA according to the invention encodes at least one peptide or protein comprising an amino acid sequence identical to or at least 80% identical to an amino acid sequence selected from the group consisting of SEQ ID NO: 1651-1654, or a fragment or variant of any one of these amino acid sequences, and further comprising an amino acid sequence identical to or at least 80% identical to an amino acid sequence selected from the group consisting of SEQ ID NO: 1 and 1455-1468, or a fragment or variant of any one of these amino acid sequences.

According to a preferred embodiment, the at least one coding sequence of the RNA according to the invention preferably comprises a nucleic acid sequence identical to or at least 80% identical to a nucleic acid sequence selected from the group consisting of SEQ ID NO: 1655 to 1710, or a fragment or variant of any one of these nucleic acid sequences, and further comprises a nucleic acid sequence identical to or at least 80% identical to a nucleic acid sequence selected from the group consisting of SEQ ID NO: 29, 72, 100, 128, 156, 184, 212, 240, 268, 296, 324, 352, 380, 489 and 1469-1650, or a fragment or variant of any one of these nucleic acid sequences.

According to a preferred embodiment, the present invention provides the RNA as described herein for use in the treatment or prophylaxis of a liver disease, wherein the treatment or prophylaxis comprises expression of both, ColG and ColH, or a fragment or variant of any of these. In that embodiment, expression of ColG and ColH, or of a fragment or variant of any of these, in the target tissue is achieved by provision (and administration, preferably as described herein) of embodiments of the RNA according to the invention encoding both, ColG and ColH or a fragment or variant of any of these.

In some embodiments, the treatment or prophylaxis of a liver disease comprises administration, of an RNA as described herein encoding ColG, or a fragment or variant thereof, and of another RNA as described herein encoding ColH, or a fragment or variant thereof, wherein the two RNAs are preferably administered concurrently.

Alternatively, the treatment or prophylaxis of a liver disease may comprise administration of an RNA as described herein, wherein the RNA encodes both, ColG and ColH, or a fragment or variant of any of these. In preferred embodiments, the RNA according to the invention is a bi- or multicistronic RNA, wherein separate coding sequences encode ColG and ColH, or a fragment or variant of any of these, respectively. As an alternative, the RNA according to the invention may comprise a coding sequence encoding a polypeptide or protein comprising both, ColG and ColH, or a fragment or variant of any of these. Therein, the amino acid sequences derived from ColG and ColH, respectively, may be separated by a linker and/or a processing site, which optionally allows for cleavage and thus separation of the amino acid sequences derived from ColG and ColH, respectively.

In a preferred embodiment, the treatment or prophylaxis of a liver disease comprises administration of both, ColG and ColH, or a fragment or variant of any of these, as described herein, wherein the molar ratio of expressed ColG or a fragment or variant thereof to expressed ColH or a fragment or variant thereof is about 1. Alternatively, the molar ratio of expressed ColG or a fragment or variant thereof to expressed ColH or a fragment or variant thereof is preferably in the range from about 0.1 to about 10, preferably from about 0.2 to about 5, more preferably from about 0.3 to about 3, even more preferably from about 0.5 to about 2, most preferably about 1. In a preferred embodiment, the molar ratio of expressed ColG or a fragment or variant thereof to expressed ColH or a fragment or variant thereof is in the range from about 1 to about 10, preferably from about 2 to about 10, from about 2 to about 5 or from about 2 to about 4. Alternatively, the molar ratio of expressed ColH or a fragment or variant thereof to expressed ColG or a fragment or variant thereof is in the range from about 1 to about 10, preferably from about 2 to about 10, from about 2 to about 5 or from about 2 to about 4. Therein, the ratios are irrespective of whether ColG and ColH, or a fragment or variant of any of these, respectively, are expressed from one or more RNAs or from the same coding sequence or from separate coding sequences.

According to a particularly preferred embodiment, the treatment or prophylaxis of a liver disease comprises administration of both, ColG and ColH, or a fragment or variant of any of these, as described herein, wherein the molar ratio of an administered coding sequence encoding ColG or a fragment or variant thereof to an administered coding sequence encoding ColH or a fragment or variant thereof is about 1. Alternatively, the treatment or prophylaxis of a liver disease comprises administration of both, ColG and ColH, or a fragment or variant of any of these, as described herein, wherein the molar ratio of an administered coding sequence encoding ColG or a fragment or variant thereof to an administered coding sequence encoding ColH or a fragment or variant thereof is preferably in the range from about 0.1 to about 10, preferably from about 0.2 to about 5, more preferably from about 0.3 to about 3, even more preferably from about 0.5 to about 2, most preferably about 1. In a preferred embodiment, the treatment or prophylaxis of a liver disease comprises administration of both, ColG and ColH, or a fragment or variant of any of these, as described herein, wherein the molar ratio of an administered coding sequence encoding ColG or a fragment or variant thereof to an administered coding sequence encoding ColH or a fragment or variant thereof is in the range from about 1 to about 10, preferably from about 2 to about 10, from about 2 to about 5 or from about 2 to about 4. Alternatively, the treatment or prophylaxis of a liver disease comprises administration of both, ColG and ColH, or a fragment or variant of any of these, as described herein, wherein the molar ratio of an administered coding sequence encoding ColH or a fragment or variant thereof to an administered coding sequence encoding ColG or a fragment or variant thereof is in the range from about 1 to about 10, preferably from about 2 to about 10, from about 2 to about 5 or from about 2 to about 4. Therein, the ratios are irrespective of whether the administered coding sequences encoding ColG and ColH, or a fragment or variant of any of these, respectively, are expressed from one (e.g. in the case of a bi- or multicistronic RNA) or more RNAs.

According to a further embodiment, the present invention concerns an RNA comprising at least one coding sequence, wherein the at least one coding sequence of the RNA encodes at least one peptide or protein comprising or consisting of CCAAT/enhancer-binding protein alpha (CEBPA), or a fragment or variant thereof. As used herein, the term "CCAAT/enhancer-binding protein alpha" may be abbreviated as, for example, "CEBPA" and typically refers to a peptide or protein comprising or consisting of an amino acid sequence identical to or at least 80% identical to any one of the amino acid sequences defined by database accession numbers NP_036656.1, P05554, NP_031704.2, P53566, NP_004355.2 or P49715, or a homolog, fragment or variant of any one of these sequences. Preferably, the term may also refer to an amino acid sequence as encoded by a nucleic acid sequence identical to or at least 80% identical to any one of the nucleic acid sequences defined by database accession numbers NM_012524.3, NM_007678.3, CCDS21145.1, NM_004364.4, CCDS54243, M37197 or ENSG00000245848, or a homolog, fragment or variant of any one of these sequences. Moreover, the term as used herein may also refer to a peptide or protein comprising or consisting of an amino acid sequence identical to or at least 80% identical to an amino acid sequence selected from the group consisting of SEQ ID NO: 8-13, or a homolog, fragment or variant of any one of said amino acid sequences.

Furthermore, the present invention also provides an RNA comprising at least one coding sequence, wherein the coding sequence encodes at least one peptide or protein comprising or consisting of CCAAT/enhancer-binding protein alpha (CEBPA) or hepatocyte nuclear factor 4 alpha (HNF4A), or a fragment or variant thereof, for use in the treatment or prophylaxis of a liver disease as described herein, wherein the liver disease is preferably selected from liver fibrosis, liver cirrhosis and hepatocellular carcinoma (HCC).

In one embodiment, the at least one coding sequence of the RNA according to the invention encodes at least one peptide or protein comprising or consisting of an amino acid sequence identical to or at least 80% identical to an amino acid sequence selected from the group consisting of SEQ ID NO: 8-13, or a fragment or variant of any one of said amino acid sequences.

In a preferred embodiment, the at least one coding sequence of the RNA according to the invention encodes at least one peptide or protein comprising or consisting of human CCAAT/enhancer-binding protein alpha (CEBPA), or a fragment or variant thereof, wherein the peptide or protein preferably comprises or consists of an amino acid sequence identical to or at least 80% identical to the amino acid sequence according to SEQ ID NO: 12 or 13, or a fragment or variant of any one of these amino acid sequences. Therein, the at least one coding sequence of the RNA preferably comprises or consists of a nucleic acid sequence identical to or at least 80% identical to a nucleic acid sequence selected from the group consisting of SEQ ID NO: 40, 41, 42, 43, 83, 84, 111, 112, 139, 140, 167, 168, 195, 196, 223, 224, 251, 252, 279, 280, 307, 308, 335, 336, 363, 364, 391 and 392, or a fragment or variant of any one of these nucleic acid sequences.

In another embodiment, the present invention provides an RNA comprising at least one coding sequence, wherein the at least one coding sequence of the RNA encodes at least one peptide or protein comprising or consisting of TNF-related apoptosis-inducing ligand (TRAIL), or a fragment or variant thereof. As used herein, the term "TNF-related apoptosis-inducing ligand" may be abbreviated as "TRAIL" or "TNFSF10" and typically refers to a protein comprising or consisting of an amino acid sequence identical to or at least 80% identical to an amino acid sequence as defined by database accession numbers NP_003801.1 or P50591, or a homolog, fragment or variant of any one of these sequences. Preferably, the term may also refer to an amino acid sequence as encoded by a nucleic acid sequence identical to or at least 80% identical to a nucleic acid sequence as defined by database accession numbers NM_003810.3, CCDS3219.1 or ENSG00000121858, or a homolog, fragment or variant of any one of these sequences. Moreover, the term as used herein may also refer to a peptide or protein comprising or consisting of an amino acid sequence identical to or at least 80% identical to an amino acid sequence selected from the group consisting of SEQ ID NO: 4-7, or a homolog, fragment or variant of any one of said amino acid sequences.

In addition, the present invention also provides an RNA comprising at least one coding sequence, wherein the coding sequence encodes at least one peptide or protein comprising or consisting of TNF-related apoptosis-inducing ligand (TRAIL), or a fragment or variant thereof, for use in the treatment or prophylaxis of a liver disease as described herein, wherein the liver disease is preferably selected from liver fibrosis and liver cirrhosis.

In one embodiment, the at least one coding sequence of the RNA according to the invention encodes at least one peptide or protein comprising or consisting of an amino acid sequence identical or at least 80% identical to an amino acid sequence selected from the group consisting of SEQ ID NO: 4-7, or a fragment or variant of any one of said amino acid sequences. Therein, the at least one coding sequence of the RNA preferably comprises or consists of a nucleic acid sequence identical or at least 80% identical to a nucleic acid sequence selected from the group consisting of SEQ ID NO: 32, 33, 34, 35, 75, 76, 77, 78, 103, 104, 105, 106, 131, 132, 133, 134, 159, 160, 161, 162, 187, 188, 189, 190, 215, 216, 217, 218, 243, 244, 245, 246, 271, 272, 273, 274, 299, 300, 301, 302, 327, 328, 329, 330, 355, 356, 357, 358, 383, 384, 385 and 386, or a fragment or variant of any one of these nucleic acid sequences.

In some embodiments, the at least one coding sequence of the RNA according to the invention encodes at least one peptide or protein comprising TNF-related apoptosis-inducing ligand (TRAIL), or a fragment or variant thereof, preferably as defined herein, wherein the encoded peptide or protein further comprises an isoleucine zipper, preferably a heterologous isoleucine zipper. Preferably, an isoleucine zipper as used herein comprises or consists of an amino acid sequence identical to or at least 80% identical to the amino acid sequence according to SEQ ID NO: 3, or a fragment or variant thereof.

In a preferred embodiment, the at least one coding sequence of the RNA according to the invention encodes at least one peptide or protein comprising TNF-related apoptosis-inducing ligand (TRAIL), or a fragment or variant thereof, preferably as defined herein, wherein the coding sequence comprises a nucleic acid sequence identical to or at least 80% identical to a nucleic acid sequence selected from the group consisting of SEQ ID NO: 30, 73, 101, 129, 157, 185, 213, 241, 269, 297, 325, 353, 381 and 499, or a fragment or variant thereof.

In another embodiment, the present invention concerns an RNA comprising at least one coding sequence, wherein the at least one coding sequence encodes at least one peptide or protein selected from the group consisting of hepatocyte nuclear factor 4 alpha (HNF4A), fibroblast growth factor 21 (FGF21), opioid growth factor receptor-like 1 (OGFRL1), Hepatocyte Growth Factor (HGF), Relaxin 1 (RLN1), Relaxin 2 (RLN2) and Relaxin 3 (RLN3), or a fragment or variant of any of these peptides or proteins. Moreover, an RNA comprising at least one coding sequence, wherein the at least one coding sequence encodes at least one peptide or protein selected from the group consisting of hepatocyte nuclear factor 4 alpha (HNF4A), fibroblast growth factor 21 (FGF21), opioid growth factor receptor-like 1 (OGFRL1), Hepatocyte Growth Factor (HGF), Relaxin 1 (RLN1), Relaxin 2 (RLN2) and Relaxin 3 (RLN3), or a fragment or variant of any of these peptides or proteins, is provided for use in the treatment or prophylaxis of a liver disease, wherein the liver disease is preferably selected from liver fibrosis and liver cirrhosis.

In a preferred embodiment, the at least one coding sequence of the RNA according to the invention encodes at least one peptide or protein comprising or consisting of an amino acid sequence identical to or at least 80% identical to an amino acid sequence selected from the group consisting of SEQ ID NO: 14-19, or a fragment or variant of any one of said amino acid sequences. Therein, the at least one coding sequence of the RNA preferably comprises or consists of a nucleic acid sequence identical to or at least 80% identical to a nucleic acid sequence selected from the group consisting of SEQ ID NO: 44, 45, 46, 47, 48, 49, 50, 51, 52, 53, 54, 85, 86, 87, 88, 89, 90, 113, 114, 115, 116, 117, 118, 141, 142, 143, 144, 145, 146, 169, 170, 171, 172, 173, 174, 197, 198, 199, 200, 201, 202, 225, 226, 227, 228, 229, 230, 253, 254, 255, 256, 257, 258, 281, 282, 283, 284, 285, 286, 309, 310, 311, 312, 313, 314, 337, 338, 339, 340, 341, 342, 365, 366, 367, 368, 369, 370, 393, 394, 395, 396, 397 and 398, or a fragment or variant of any one of these nucleic acid sequences.

In a preferred embodiment, the at least one coding sequence of the RNA according to the present invention does not encode vascular endothelial growth factor (VEGF) or a fragment or variant thereof. More preferably, the at least one coding sequence does not encode VEGF-A. According to one embodiment, the RNA according to the present invention does not comprise a nucleic acid sequence according to SEQ ID NO: 3 of WO2014/158795.

In some embodiments, the at least one coding sequence of the RNA according to the present invention does not encode a cell signaling molecule, a cytokine or an antibody. According to another embodiment, the at least one coding sequence of the RNA according to the present invention does not encode IL-1, IL-2, IL-11, Interferon-alpha, Tumor necrosis factor, Apoptosis-inducing factor, CBX family proteins, Bcl-x, Rituxan, Herceptin, Ocrelizumab, Ofatumumab, Gemtuzumab, Alemtuzumab, Trastuzumab, Nimotuzumab, Cetuximab, Bavacizumab, Palivizumab, Efungumab, Exbivirumab, Foravirumab, Libivirumab, Rafiviumab, Regavirumab, Sevirumab, Tuvirumab, Felvizumab, Motavizumab, Suvizumab, Nebacumab, Panobacumab, Raxibacumab, Edobacomab, Pagibaimab, Tefibazumab or Urtoxazumab, or a combination thereof.

According to certain embodiments, the RNA according to the invention is mono-, bi-, or multicistronic, preferably as defined herein. The coding sequences in a bi- or multicistronic RNA preferably encode a distinct peptide or protein as defined herein or a fragment or variant thereof. Preferably, the coding sequences encoding two or more peptides or proteins may be separated in the bi- or multicistronic RNA by at least one IRES (internal ribosomal entry site) sequence, as defined below. Thus, the term "encoding two or more peptides or proteins" may mean, without being limited thereto, that the bi- or even multicistronic RNA, may encode e.g. at least two, three, four, five, six or more (preferably different) peptides or proteins as described herein or their fragments or variants within the definitions provided herein. More preferably, without being limited thereto, the bi- or even multicistronic mRNA, may encode, for example, at least two, three, four, five, six or more (preferably different) peptides or proteins as defined herein or their fragments or variants as defined herein. In this context, a so-called IRES (internal ribosomal entry site) sequence as defined above can function as a sole ribosome binding site, but it can also serve to provide a bi- or even multicistronic mRNA as defined above, which encodes several peptides or proteins, which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV).

According to a further embodiment the at least one coding sequence of the RNA according to the invention may encode at least two, three, four, five, six, seven, eight, nine and more peptides or proteins (or fragments or variants thereof) as defined herein linked with or without an amino acid linker sequence, wherein said linker sequence can comprise rigid linkers, flexible linkers, cleavable linkers (e.g., self-cleaving peptides) or a combination thereof. Therein, the peptides or proteins (or fragments or variants thereof) may be identical or different or a combination thereof.

Preferably, the at least one coding sequence of the RNA according to the invention comprises at least two, three, four, five, six, seven, eight, nine or more nucleic acid sequences identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 32-71, 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of these nucleic acid sequences.

Preferably, the RNA comprising at least one coding sequence as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

The RNA according to the invention may further be single stranded or double stranded. When provided as a double stranded RNA, the RNA according to the invention preferably comprises a sense and a corresponding antisense strand.

In a preferred embodiment, the RNA comprising at least one coding sequence as defined herein is an mRNA, a viral RNA or a replicon RNA. Preferably, the RNA is an artificial nucleic acid, more preferably as described herein.

According to a further embodiment, the RNA, preferably an mRNA, according to the invention is a modified RNA, preferably a modified RNA as described herein. A modified RNA as used herein does preferably not comprise a chemically modified sugar, a chemically modified backbone or a chemically modified nucleobase. More preferably, a modified RNA as used herein does not comprise a chemically modified nucleoside or a chemically modified nucleotide. It is further preferred that a modified RNA as used herein does not comprise a chemical modification as described in international patent application WO 2014/158795.

In the context of the present invention, a modification as defined herein preferably leads to a stabilization of the RNA according to the invention. More preferably, the invention thus provides a stabilized RNA comprising at least one coding sequence as defined herein.

According to one embodiment, the RNA of the present invention may thus be provided as a "stabilized mRNA", that is to say as an RNA that is essentially resistant to in vivo degradation (e.g. by an exo- or endo-nuclease).

Stabilization of an RNA can be achieved, for example, by a modified phosphate backbone of the RNA of the present invention. A backbone modification in connection with the present invention is a modification, in which phosphates of the backbone of the nucleotides contained in the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the RNA as defined herein.

Modifications

Chemical Modifications

The term "RNA modification" as used herein may refer to chemical modifications comprising backbone modifications as well as sugar modifications or base modifications.

In this context, a modified RNA as defined herein may contain nucleotide analogues/modifications, e.g. backbone modifications, sugar modifications or base modifications. A backbone modification in connection with the present invention is a modification, in which phosphates of the backbone of the nucleotides contained in an RNA as defined herein are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues, which are applicable for transcription and/or translation.

Sugar Modifications:

The modified nucleosides and nucleotides, which may be incorporated into a modified RNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diarylamino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified RNA can include nucleotides containing, for instance, arabinose as the sugar.

Backbone Modifications:

The phosphate backbone may further be modified in the modified nucleosides and nucleotides, which may be incorporated into a modified RNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications

The modified nucleosides and nucleotides, which may be incorporated into a modified RNA as described herein can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5"-triphosphate, 2'-O-Methyl-inosine-5"-triphosphate 4-thiouridine-5-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2-deoxycytidine-5'-triphosphate, 5-Bromo-2'-deoxyuridine-5'-triphosphate, 5-iodocytidine-5-triphosphate, 5-Iodo-2 deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5-triphosphate, 5-Propynyl-2-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5-triphosphate, 8-azaadenosine-5'-triphosphate, 8-azidoadenosine-5'-triphosphate, benzimidazole-riboside-5'-triphosphate, N1-methyladenosine-5-triphosphate, N1-methylguanosine-5'-triphosphate, N6-methyladenosine-5'-triphosphate, O6-methylguanosine-5'-triphosphate, pseudouridine-5'-triphosphate, or puromycin-5"-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deazaguanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified RNA may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-aminopurine, Pseudo-iso-cytidine, 6-Chloro-purine, N6-methyl-adenosine, α-thio-adenosine, 8-azido-adenosine, 7-deaza-adenosine.

Lipid Modification

According to a further embodiment, a modified RNA as defined herein can contain a lipid modification. Such a lipid-modified RNA typically comprises an RNA as defined herein. Such a lipid-modified RNA as defined herein typically further comprises at least one linker covalently linked with that RNA, and at least one lipid covalently linked with the respective linker. Alternatively, the lipid-modified RNA comprises at least one RNA as defined herein and at least one (bifunctional) lipid covalently linked (without a linker) with that RNA. According to a third alternative, the lipid-modified RNA comprises an RNA molecule as defined herein, at least one linker covalently linked with that RNA, and at least one lipid covalently linked with the respective linker, and also at least one (bifunctional) lipid covalently linked (without a linker) with that RNA. In this context, it is particularly preferred that the lipid modification is present at the terminal ends of a linear RNA sequence.

G/C Content Modification

According to another embodiment, the RNA of the present invention, preferably an mRNA, may be modified, and thus stabilized, by modifying the guanosine/cytosine (G/C) content of the RNA, preferably of the at least one coding sequence of the RNA of the present invention.

In a particularly preferred embodiment of the present invention, the G/C content of the coding sequence (coding region) of the RNA of the present invention is modified, particularly increased, compared to the G/C content of the coding region of the respective wild type RNA, i.e. the unmodified RNA. The amino acid sequence encoded by the RNA is preferably not modified as compared to the amino acid sequence encoded by the respective wild type RNA. This modification of the RNA of the present invention is based on the fact that the sequence of any RNA region to be translated is important for efficient translation of that RNA. Thus, the composition of the RNA and the sequence of various nucleotides are important. In particular, sequences having an increased G (guanosine)/C (cytosine) content are more stable than sequences having an increased A (adenosine)/U (uracil) content. According to the invention, the codons of the RNA are therefore varied compared to the respective wild type RNA, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the RNA, there are various possibilities for modification of the RNA sequence, compared to its wild type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CM to CAG; the codons for Ile can be modified from AUU or AUA to AUC; the codons for Thr can be modified from ACU or ACA to ACC or ACG; the codon for Asn can be modified from MU to MC; the codon for Lys can be modified from MA to MG; the codons for Val can be modified from GUU or GUA to GUC or GUG; the codon for Asp can be modified from GAU to GAC; the codon for Glu can be modified from GM to GAG; the stop codon UM can be modified to UAG or UGA. In the case of the codons for Met (AUG) and Trp (UGG), on the other hand, there is no possibility of sequence modification. The substitutions listed above can be used either individually or in all possible combinations to increase the G/C content of the at least one mRNA of the composition of the present invention compared to its particular wild type mRNA (i.e. the original sequence). Thus, for example, all codons for Thr occurring in the wild type sequence can be modified to ACC (or ACG). Preferably, however, for example, combinations of the above substitution possibilities are used:

substitution of all codons coding for Thr in the original sequence (wild type mRNA) to ACC (or ACG) and substitution of all codons originally coding for Ser to UCC (or UCG or AGC); substitution of all codons coding for Ile in the original sequence to AUC and substitution of all codons originally coding for Lys to MG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to MC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding region of the RNA of the present invention is increased by at least 7%, more preferably by at least 15%, particularly preferably by at least 20%, compared to the G/C content of the coding region of the wild type RNA, which codes for a peptide or protein as defined herein or a fragment or variant thereof. According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for a peptide or protein as defined herein or a fragment or variant thereof or the whole sequence of the wild type RNA sequence are substituted, thereby increasing the GC/content of said sequence. In this context, it is particularly preferable to increase the G/C content of the RNA of the present invention, preferably of the at least one coding region of the RNA according to the invention, to the maximum (i.e. 100% of the substitutable codons) as compared to the wild type sequence. According to the invention, a further preferred modification of the RNA of the present invention is based on the finding that the translation efficiency is also determined by a different frequency in the occurrence of tRNAs in cells. Thus, if so-called "rare codons" are present in the RNA of the present invention to an increased extent, the corresponding modified RNA sequence is translated to a significantly poorer degree than in the case where codons coding for relatively "frequent" tRNAs are present. According to the invention, in the modified RNA of the present invention, the region which codes for a peptide or protein as defined herein or a fragment or variant thereof is modified compared to the corresponding region of the wild type RNA such that at least one codon of the wild type sequence, which codes for a tRNA which is relatively rare in the cell, is exchanged for a codon, which codes for a tRNA which is relatively frequent in the cell and carries the same amino acid as the relatively rare tRNA. By this modification, the sequences of the RNA of the present invention is modified such that codons for which frequently occurring tRNAs are available are inserted. In other words, according to the invention, by this modification all codons of the wild type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred. According to the invention, it is particularly preferable to link the sequential G/C content which is increased, in particular maximized, in the modified RNA of the present invention, with the "frequent" codons without modifying the amino acid sequence of the peptide or protein encoded by the coding region of the RNA. This preferred embodiment allows provision of a particularly efficiently translated and stabilized (modified) RNA of the present invention. The determination of a modified RNA of the present invention as described above (increased G/C content; exchange of tRNAs) can be carried out using the computer program explained in WO 02/098443—the disclosure content of which is included in its full scope in the present invention. Using this computer program, the nucleotide sequence of any desired RNA can be modified with the aid of the genetic code or the degenerative nature thereof such that a maximum G/C content results, in combination with the use of codons which code for tRNAs occurring as frequently as possible in the cell, the amino acid sequence coded by the modified RNA preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the RNA of the present invention is increased compared to the A/U content in the environment of the ribosome binding site of its respective wild type mRNA. This modification (an increased A/U content around the ribosome binding site) increases the efficiency of ribosome binding to the RNA. An effective binding of the ribosomes to the ribosome binding site (Kozak sequence: SEQ ID NO: 1454; the AUG forms the start codon) in turn has the effect of an efficient translation of the RNA. According to a further embodiment of the present invention, the RNA of the present invention may be modified with respect to potentially destabilizing sequence elements. Particularly, the coding region and/or the 5' and/or 3' untranslated region of this RNA may be modified compared to the respective wild type RNA such that it contains no destabilizing sequence elements, the encoded amino acid sequence of the modified RNA preferably not being modified compared to its respective wild type RNA. It is known that, for example in sequences of eukaryotic RNAs, destabilizing sequence elements (DSE) occur, to which signal proteins bind and regulate enzymatic degradation of RNA in vivo. For further stabilization of the modified RNA, optionally in the region which encodes a peptide or protein as defined herein or a fragment or variant thereof, one or more such modifications compared to the corresponding region of the wild type RNA can therefore be carried out, so that no or substantially no destabilizing sequence elements are contained there. According to the invention, DSE present in the untranslated regions (3'- and/or 5'-UTR) can also be eliminated from the RNA of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The RNA of the present invention is therefore preferably modified compared to the respective wild type RNA such that the RNA of the present invention contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969-1980). These sequence motifs are also preferably removed in the RNA of the present invention.

According to a preferred embodiment, the present invention provides an RNA as defined herein comprising at least one coding sequence, wherein the at least one coding sequence preferably comprises or consists of a nucleic acid sequence identical or at least 80% identical to a nucleic acid sequence selected from the group consisting of SEQ ID NO: 75, 76, 77, 78, 79, 80, 81, 82, 83, 84, 85, 86, 87, 88, 89, 90, 91, 92, 93, 94, 95, 96, 97, 98, 99, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of these nucleic acid sequences.

In a further preferred embodiment, the at least one coding sequence of the RNA according to the invention comprises or consists of a nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 75, 76, 77, 78, 79, 80, 81, 82, 83, 84, 85, 86, 87, 88, 89, 90, 91, 92, 93, 94, 95, 96, 97, 98, 99, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of these nucleic acid sequences.

Sequences Adapted to Human Codon Usage

According to the invention, a further preferred modification of the RNA of the present invention is based on the finding that codons encoding the same amino acid typically occur at different frequencies. According to the invention, in the modified RNA of the present invention, the coding sequence (coding region) as defined herein is preferably modified compared to the corresponding region of the respective wild type RNA such that the frequency of the codons encoding the same amino acid corresponds to the naturally occurring frequency of that codon according to the human codon usage as e.g. shown in Table 1.

For example, in the case of the amino acid alanine (Ala) present in an amino acid sequence encoded by the at least one coding sequence of the RNA according to the invention, the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 1).

TABLE 1

Human codon usage table

| Amino acid | codon | fraction | /1000 |
| --- | --- | --- | --- |
| Ala | GCG | 0.10 | 7.4 |
| Ala | GCA | 0.22 | 15.8 |
| Ala | GCT | 0.28 | 18.5 |
| Ala | GCC* | 0.40 | 27.7 |
| Cys | TGT | 0.42 | 10.6 |
| Cys | TGC* | 0.58 | 12.6 |
| Asp | GAT | 0.44 | 21.8 |
| Asp | GAC* | 0.56 | 25.1 |
| Glu | GAG* | 0.59 | 39.6 |
| Glu | GAA | 0.41 | 29.0 |
| Phe | TTT | 0.43 | 17.6 |
| Phe | TTC* | 0.57 | 20.3 |
| Gly | GGG | 0.23 | 16.5 |
| Gly | GGA | 0.26 | 16.5 |
| Gly | GGT | 0.18 | 10.8 |
| Gly | GGC* | 0.33 | 22.2 |
| His | CAT | 0.41 | 10.9 |
| His | CAC* | 0.59 | 15.1 |
| Ile | ATA | 0.14 | 7.5 |
| Ile | ATT | 0.35 | 16.0 |
| Ile | ATC* | 0.52 | 20.8 |
| Lys | AAG* | 0.60 | 31.9 |
| Lys | AAA | 0.40 | 24.4 |
| Leu | TTG | 0.12 | 12.9 |
| Leu | TTA | 0.06 | 7.7 |
| Leu | CTG* | 0.43 | 39.6 |
| Leu | CTA | 0.07 | 7.2 |
| Leu | CTT | 0.12 | 13.2 |
| Leu | CTC | 0.20 | 19.6 |
| Met | ATG* | 1 | 22.0 |
| Asn | AAT | 0.44 | 17.0 |
| Asn | AAC* | 0.56 | 19.1 |
| Pro | CCG | 0.11 | 6.9 |
| Pro | CCA | 0.27 | 16.9 |
| Pro | CCT | 0.29 | 17.5 |
| Pro | CCC* | 0.33 | 19.8 |
| Gln | CAG* | 0.73 | 34.2 |
| Gln | CAA | 0.27 | 12.3 |
| Arg | AGG | 0.22 | 12.0 |
| Arg | AGA* | 0.21 | 12.1 |
| Arg | CGG | 0.19 | 11.4 |
| Arg | CGA | 0.10 | 6.2 |
| Arg | CGT | 0.09 | 4.5 |
| Arg | CGC | 0.19 | 10.4 |
| Ser | AGT | 0.14 | 12.1 |
| Ser | AGC* | 0.25 | 19.5 |
| Ser | TCG | 0.06 | 4.4 |

TABLE 1-continued

Human codon usage table

| Amino acid | codon | fraction | /1000 |
|---|---|---|---|
| Ser | TCA | 0.15 | 12.2 |
| Ser | TCT | 0.18 | 15.2 |
| Ser | TCC | 0.23 | 17.7 |
| Thr | ACG | 0.12 | 6.1 |
| Thr | ACA | 0.27 | 15.1 |
| Thr | ACT | 0.23 | 13.1 |
| Thr | ACC* | 0.38 | 18.9 |
| Val | GTG* | 0.48 | 28.1 |
| Val | GTA | 0.10 | 7.1 |
| Val | GTT | 0.17 | 11.0 |
| Val | GTC | 0.25 | 14.5 |
| Trp | TGG* | 1 | 13.2 |
| Tyr | TAT | 0.42 | 12.2 |
| Tyr | TAC* | 0.58 | 15.3 |
| Stop | TGA* | 0.61 | 1.6 |
| Stop | TAG | 0.17 | 0.8 |
| Stop | TAA | 0.22 | 1.0 |

*most frequent codon

In a preferred embodiment, the present invention provides an RNA comprising at least one coding sequence, wherein the coding sequence comprises a nucleic acid sequence identical or at least 80% identical to a nucleic acid sequence selected from the group consisting of SEQ ID NO: 131, 132, 133, 134, 135, 136, 137, 138, 139, 140, 141, 142, 143, 144, 145, 146, 147, 148, 149, 150, 151, 152, 153, 154 and 155, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 131, 132, 133, 134, 135, 136, 137, 138, 139, 140, 141, 142, 143, 144, 145, 146, 147, 148, 149, 150, 151, 152, 153, 154 and 155, or a fragment or variant of any one of said nucleic acid sequences.

Codon-Optimized Sequences

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table 1, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to a preferred embodiment, the RNA of the present invention comprises at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the RNA according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

In a preferred embodiment, the present invention provides an RNA comprising at least one coding sequence, wherein the coding sequence comprises a nucleic acid sequence identical or at least 80% identical to a nucleic acid sequence selected from the group consisting of SEQ ID NO: 159, 160, 161, 162, 163, 164, 165, 166, 167, 168, 169, 170, 171, 172, 173, 174, 175, 176, 177, 178, 179, 180, 181, 182 and 183, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 159, 160, 161, 162, 163, 164, 165, 166, 167, 168, 169, 170, 171, 172, 173, 174, 175, 176, 177, 178, 179, 180, 181, 182 and 183, or a fragment or variant of any one of said nucleic acid sequences.

C-Optimized Sequences

According to another embodiment, the RNA of the present invention may be modified by modifying, preferably increasing, the cytosine (C) content of the RNA, preferably of the coding region of the RNA.

In a particularly preferred embodiment of the present invention, the C content of the coding region of the RNA of the present invention is modified, preferably increased, compared to the C content of the coding region of the respective wild type RNA, i.e. the unmodified RNA. The amino acid sequence encoded by the at least one coding sequence of the RNA of the present invention is preferably not modified as compared to the amino acid sequence encoded by the respective wild type mRNA.

In a preferred embodiment of the present invention, the modified RNA is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the target RNA wild type sequence, which are "cytosine content optimizable" are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target RNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term "cytosine content-optimizable codon" as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C-content and reflects a C-enriched modified mRNA sequence. According to a preferred embodiment, the RNA of the present invention, preferably the at least one coding sequence of the RNA of the present invention, comprises or consists of a C-maximized RNA sequence containing C-optimized codons for all potentially C-optimizable codons. Accordingly, 100% or all of the theoretically replaceable C-optimizable codons are preferably replaced by C-optimized codons over the entire length of the coding region.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or the codon UGU that codes for Cys may be exchanged by the codon UGC encoding the same amino acid, and/or the codon GAU which codes for Asp may be exchanged by the codon GAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Ile may be exchanged by the codon AUC, and/or any of the codons UUG, UUA, CUG, CUA, CUU coding for Leu may be exchanged by the codon CUC encoding the same amino acid, and/or the codon AAU that codes for Asn may be exchanged by the codon MC encoding the same amino acid, and/or any of the codons CCG, CCA, CCU coding for Pro may be exchanged by the codon CCC encoding the same amino acid, and/or any of the codons AGG, AGA, CGG, CGA, CGU coding for Arg may be exchanged by the codon CGC encoding the same amino acid, and/or any of the codons AGU, AGC, UCG, UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon GUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding region results in a C-maximized coding sequence. In the context of the invention, at least 70%, preferably at least 80%, more preferably at least 90%, of the non C-optimized codons within the at least one coding region of the RNA according to the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in a C-optimized RNA of the invention, at least 50% of the C-optimizable wild type codons for any given amino acid are replaced by C-optimized codons, e.g. any modified C-enriched RNA preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GM coding for Glu may be exchanged by the relative frequent codon GAG coding for the same amino acid, and/or the relatively rare codon MA coding for Lys may be exchanged by the relative frequent codon MG coding for the same amino acid, and/or the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UM, UAG) may be exchanged by the relatively frequent stop codon opal (UGA).

The single substitutions listed above may be used individually as well as in all possible combinations in order to optimize the cytosine-content of the modified RNA compared to the wild type mRNA sequence.

Accordingly, the at least one coding sequence as defined herein may be changed compared to the coding region of the respective wild type RNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

In a preferred embodiment, the present invention provides an RNA comprising at least one coding sequence, wherein the coding sequence comprises a nucleic acid sequence identical or at least 80% identical to a nucleic acid sequence selected from the group consisting of SEQ ID NO: 103, 104, 105, 106, 107, 108, 109, 110, 111, 112, 113, 114, 115, 116, 117, 118, 119, 120, 121, 122, 123, 124, 125, 126 and 127, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 103, 104, 105, 106, 107, 108, 109, 110, 111, 112, 113, 114, 115, 116, 117, 118, 119, 120, 121, 122, 123, 124, 125, 126 and 127, or a fragment or variant of any one of said nucleic acid sequences.

According to a particularly preferred embodiment, the invention provides an RNA, preferably an mRNA, comprising at least one coding sequence as defined herein, wherein the G/C content of the at least one coding sequence of the RNA is increased compared to the G/C content of the corresponding coding sequence of the corresponding wild type RNA, and/or wherein the C content of the at least one coding sequence of the RNA is increased compared to the C content of the corresponding coding sequence of the corresponding wild type RNA, and/or wherein the codons in the at least one coding sequence of the RNA are adapted to human codon usage, wherein the codon adaptation index (CAI) is preferably increased or maximised in the at least one coding sequence of the RNA, and wherein the amino acid sequence encoded by the RNA is preferably not being modified compared to the amino acid sequence encoded by the corresponding wild type RNA.

In a preferred embodiment, the present invention provides an RNA comprising at least one coding sequence, wherein the coding sequence comprises a nucleic acid sequence identical or at least 80% identical to a nucleic acid sequence selected from the group consisting of SEQ ID NO: 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of said nucleic acid sequences.

5'-Cap

According to another preferred embodiment of the invention, a modified RNA as defined herein, can be modified by the addition of a so-called "5'-cap" structure, which preferably stabilizes the RNA as described herein. A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified mRNA in this context. Accordingly, a modified RNA of the present invention may comprise a m7GpppN as 5'-cap, but additionally the modified RNA typically comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine. Accordingly, the RNA according to the invention preferably comprises a 5'-cap structure.

In a preferred embodiment, the RNA according to the invention comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding sequence of the RNA of the invention. Even if 5'- or 3'-UTR elements derived from naturally occurring genes are preferred, also synthetically engineered UTR elements may be used in the context of the present invention.

The term "3'-UTR element" typically refers to a nucleic acid sequence, which comprises or consists of a nucleic acid sequence that is derived from a 3'-UTR or from a variant of a 3'-UTR. A 3'-UTR element in the sense of the present invention may represent the 3'-UTR of an RNA, preferably an mRNA. Thus, in the sense of the present invention, preferably, a 3'-UTR element may be the 3'-UTR of an RNA, preferably of an mRNA, or it may be the transcription template for a 3'-UTR of an RNA. Thus, a 3'-UTR element preferably is a nucleic acid sequence which corresponds to the 3'-UTR of an RNA, preferably to the 3'-UTR of an mRNA, such as an mRNA obtained by transcription of a genetically engineered vector construct. Preferably, the 3'-UTR element fulfils the function of a 3'-UTR or encodes a sequence which fulfils the function of a 3'-UTR.

According to a preferred embodiment, the RNA, preferably an mRNA, according to the invention comprises a 5'-cap structure and/or at least one 3'-untranslated region element (3'-UTR element), preferably as defined herein. More preferably, the RNA further comprises a 5'-UTR element as defined herein.

Poly(A) Tail

According to a further preferred embodiment, the RNA of the present invention may contain a poly(A) tail on the 3'-terminus of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the RNA of the present invention is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the RNA according to the present invention using commercially available polyadenylation kits and corresponding protocols known in the art.

Alternatively, the RNA as described herein optionally comprises a polyadenylation signal, which is defined herein as a signal, which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C) Tail

According to a further preferred embodiment, the RNA of the present invention may contain a poly(C) tail on the 3'-terminus of typically about 10 to 200 cytidine nucleotides, preferably about 10 to 100 cytidine nucleotides, more preferably about 20 to 70 cytidine nucleotides or even more preferably about 20 to 60 or even 10 to 40 cytidine nucleotides.

3'-UTR

In a further preferred embodiment, the RNA according to the invention further comprises at least one 3'-UTR element. Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the RNA of the present invention comprises a 3'-UTR element, which may be derivable from a gene that relates to an mRNA with an enhanced half-life (that provides a stable mRNA), for example a 3'-UTR element as defined and described below. Preferably, the 3'-UTR element is a nucleic acid sequence derived from a 3'-UTR of a gene, which preferably encodes a stable mRNA, or from a homolog, a fragment or a variant of said gene.

In a particularly preferred embodiment, the 3'-UTR element comprises or consists of a nucleic acid sequence, which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NO: 1369-1390 of the patent application WO2013/143700, whose disclosure is incorporated herein by reference, or from a homolog, a fragment or a variant thereof. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according to SEQ ID NO: 1445 or the corresponding RNA sequence SEQ ID NO: 1446, or a fragment or variant thereof.

In this context it is particularly preferred that the RNA according to the invention comprises a 3'-UTR element comprising a corresponding RNA sequence derived from the nucleic acids according to SEQ ID NOs: 1369-1390 of the patent application WO2013/143700, or a fragment, homolog or variant thereof.

Most preferably the 3'-UTR element comprises the nucleic acid sequence derived from a fragment of the human albumin gene according to SEQ ID NO: 1447 (corresponding to SEQ ID NO: 1376 of the patent application WO2013/143700) or 1449.

In this context, it is particularly preferred that the 3'-UTR element of the RNA according to the present invention comprises or consists of a corresponding RNA sequence of the nucleic acid sequence according to SEQ ID NO: 1447 or 1449 as shown in SEQ ID NO: 1448 or 1450.

In another particularly preferred embodiment, the 3'-UTR element comprises or consists of a nucleic acid sequence which is derived from a 3'-UTR of an α-globin gene, preferably a vertebrate α- or β-globin gene, more preferably a mammalian α- or β-globin gene, most preferably a human α- or β-globin gene according to SEQ ID NOs: 1437, 1439 or 1441 or the corresponding RNA sequences SEQ ID NOs: 1438, 1440 or 1442:

3'-UTR of *Homo sapiens* hemoglobin, alpha 1 (HBA1) GCTGGAGCCTCGGTGGC-CATGTTCTTGCCCCTTGGGCCTCCCCCCAGCCC-CTCCTCCCCTTTCCTGCACCCGTACCCCCG TGGTCTTTGAATAAAGTCTGAGTGGGCGGC (SEQ ID NO: 1437 corresponding to SEQ ID NO: 1370 of the patent application WO2013/143700)

3'-UTR of *Homo sapiens* hemoglobin, alpha 2 (HBA2) GCTG-GAGCCTCGGTAGCCGTTCCTCCTGCCCGCTGGG-CCTCCCAACGGGCCCTCCTCCCCTCCTTTGCA-CCGGCCCTTCCT GGTCTTTGAATAAAGTCT-GAGTGGGCAG (SEQ ID NO: 1439 corresponding to SEQ ID NO: 1371 of the patent application WO2013/143700)

3'-UTR of *Homo sapiens* hemoglobin, beta (HBB) GCTCGCTTTCTTGCTGTCCAATTTCTAT-TAAAGGTTCCTTTGTTCCCTAAGTCCAAC-TACTAAACTGGGGGATATTATGAA GGGCCTTGAG-CATCTGGATTCTGCCTAATAAAAAACATTTATTTT-CATTGC (SEQ ID NO: 1441 corresponding to SEQ ID NO: 1372 of the patent application WO2013/143700)

For example, the 3'-UTR element may comprise or consist of the center, α-complex-binding portion of the 3'-UTR of an α-globin gene, such as of a human α-globin gene, or a homolog, a fragment, or a variant of an α-globin gene, preferably according to SEQ ID NO: 1443:

Center, α-complex-binding portion of the 3'-UTR of an α-globin gene (also named herein as "muag") GCCC-GATGGGCCTCC-CAACGGGCCCTCCTCCCCTCCTTGCACCG (SEQ ID NO: 1443 corresponding to SEQ ID NO: 1393 of the patent application WO2013/143700).

In this context it is particularly preferred that the 3'-UTR element of the RNA according to the invention comprises or consists of a corresponding RNA sequence of the nucleic acid sequence according to SEQ ID NO: 1443 as shown in SEQ ID NO: 1444, or a homolog, a fragment or variant thereof.

The term "a nucleic acid sequence which is derived from the 3'-UTR of a [ . . . ] gene" preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

5'-UTR

In a particularly preferred embodiment, the at least one mRNA of the inventive composition comprises at least one 5'-untranslated region element (5'-UTR element). Preferably, the at least one 5'-UTR element comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the at least one mRNA of the inventive composition is provided by the coding region.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than Homo sapiens, which are homologous to the sequences according to SEQ ID NOs: 1-1363, SEQ ID NO: 1395, SEQ ID NO: 1421 and SEQ ID NO: 1422 of the patent application WO2013/143700.

In a preferred embodiment, the 5'-UTR element of the RNA according to the invention comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5"TOP to the nucleotide position immediately 5" to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'-end of the sequences) corresponds to the 5'-UTR of said sequences.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1431 (5'-UTR of human ribosomal protein Large 32 lacking the 5'-terminal oligopyrimidine tract: GGCGCTGCCTACGGAGGTGGCAGC-CATCTCcTTCTCGGCATC; corresponding to SEQ ID NO: 1368 of the patent application WO2013/143700) or preferably to a corresponding RNA sequence (SEQ ID NO: 1432), or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1431 or more preferably to a corresponding RNA sequence (SEQ ID NO: 1432), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the RNA according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'TOP of said genes, and wherein optionally the 5'-UTR element starts at its 5'-end with a nucleotide located at position 1, 2, 3, 4, 5, 6, 7, 8, 9 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP syn-thase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'-UTR element does not comprise the 5'TOP of said gene.

In further particularly preferred embodiments, the 5'-UTR element comprises or consists of a nucleic acid sequence, which is derived from a vertebrate hydroxysteroid (17-beta) dehydrogenase 4 gene (HSD17B4), preferably from a mammalian hydroxysteroid (17-beta) dehydrogenase 4 gene (HSD17B4). More preferably, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1435 or preferably to a corresponding RNA sequence according to SEQ ID NO: 1436, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1435 or more preferably to a corresponding RNA sequence (SEQ ID NO: 1436), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, or a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1433 (5'-UTR of ATP5A1 lacking the 5'-terminal oligopyrimidine tract: GCGGCTCGGCCTTTTGTCCCAGTCAGTCCG-GAGGCTGCGGCTGCAGAAGTACCGCCTGCG-GAGTAACTGCAAAG; corresponding to SEQ ID NO: 1414 of the patent application WO2013/143700) or preferably to a corresponding RNA sequence (SEQ ID NO: 1434), or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1433 or more preferably to a corresponding RNA sequence (SEQ ID NO: 1434), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5'-UTR element and the at least one 3'-UTR element act synergistically to increase protein production from the at least one mRNA of the inventive composition as described above.

Histone Stem-Loop

In a particularly preferred embodiment, the RNA according to the invention comprises a histone stem-loop sequence/structure. Such histone stem-loop sequences are preferably selected from histone stem-loop sequences as disclosed in WO2012/019780, the disclosure of which is incorporated herewith by reference.

A histone stem-loop sequence, suitable to be used within the present invention, is preferably selected from at least one of the following formulae (I) or (II):

formula (I) (stem-loop sequence without stem bordering elements):

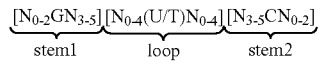

formula (II) (stem-loop sequence with stem bordering elements):

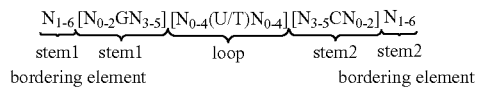

wherein:

stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment, the RNA according to the invention may comprise at least one histone stem-loop sequence according to at least one of the following specific formulae (Ia) or (IIa):

formula (Ia) (stem-loop sequence without stem bordering elements):

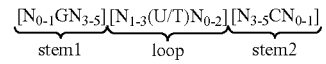

formula (IIa) (stem-loop sequence with stem bordering elements):

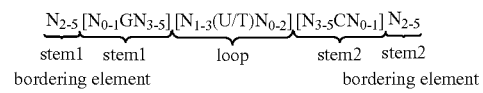

wherein:
N, C, G, T and U are as defined above.

According to a further more particularly preferred embodiment, the RNA according to the invention may comprise at least one histone stem-loop sequence according to at least one of the following specific formulae (Ib) or (IIb):

formula (Ib) (stem-loop sequence without stem bordering elements):

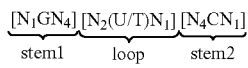

formula (IIb) (stem-loop sequence with stem bordering elements):

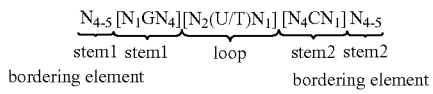

wherein:
N, C, G, T and U are as defined above.

A particularly preferred histone stem-loop sequence is the sequence CAAAGGCTCTTTTCAGAGCCACCA (according to SEQ ID NO: 1451) or more preferably the corresponding RNA sequence CAAAGGCUCUUUUCAGAGCCACCA (according to SEQ ID NO: 1452).

Signal Peptide

According to another particularly preferred embodiment, the RNA according to the invention may additionally or alternatively encode a secretory signal peptide. Such signal peptides are sequences, which typically exhibit a length of about 15 to 30 amino acids and are preferably located at the N-terminus of the encoded peptide, without being limited thereto. Signal peptides as defined herein preferably allow the transport of the peptide or protein as encoded by the at least one mRNA of the composition into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulines as defined herein, signal sequences of the invariant chain of immunoglobulines or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartment. Most preferably, signal sequences of MHC class I molecule HLA-A*0201 may be used according to the present invention. For example, a signal peptide derived from HLA-A is preferably used in order to promote secretion of the encoded peptide or protein as defined herein or a fragment or variant thereof. More preferably, an HLA-A signal peptide is fused to an encoded peptide or protein as defined herein or to a fragment or variant thereof:

Any of the above modifications may be applied to the RNA of the present invention, and further to any RNA as used in the context of the present invention and may be, if suitable or necessary, be combined with each other in any combination, provided, these combinations of modifications do not interfere with each other in the respective at least one mRNA. A person skilled in the art will be able to take his choice accordingly.

RNA Constructs

The RNA, preferably an mRNA, according to the invention, which comprises at least one coding sequence as defined herein, may preferably comprise a 5'-UTR and/or a 3'-UTR preferably containing at least one histone stem-loop. Where, in addition to the peptide or protein as defined herein or a fragment or variant thereof, a further peptide or protein is encoded by the at least one coding sequence of the RNA according to the invention, the encoded peptide or protein is preferably no histone protein, no reporter protein and/or no marker or selection protein, as defined herein. The 3'-UTR of the RNA according to the invention preferably comprises also a poly(A) and/or a poly(C) sequence as defined herein. The single elements of the 3'-UTR may occur therein in any order from 5' to 3' along the sequence of the RNA of the present invention. In addition, further elements as described herein, may also be contained, such as a stabilizing sequence as defined herein (e.g. derived from the UTR of a globin gene), IRES sequences, etc. Each of the elements may also be repeated in the RNA according to the invention at least once (particularly in di- or multicistronic constructs), preferably twice or more. As an example, the single elements may be present in the RNA according to the invention in the following order (wherein the RNA may optionally comprise a 5'-UTR element as described herein 5' of the coding region):

5'-coding region-histone stem-loop-poly(A)/(C) sequence-3'; or

5'-coding region-poly(A)/(C) sequence-histone stem-loop-3'; or

5'-coding region-histone stem-loop-polyadenylation signal-3'; or

5'-coding region-polyadenylation signal-histone stem-loop-3'; or

5'-coding region-histone stem-loop-histone stem-loop-poly(A)/(C) sequence-3'; or 5'-coding region-histone stem-loop-histone stem-loop-polyadenylation signal-3'; or 5'-coding region-stabilizing sequence-poly(A)/(C) sequence-histone stem-loop-3'; or 5'-coding region-stabilizing sequence-poly(A)/(C) sequence-poly(A)/(C) sequence-histone stem-loop-3'; or 5'-coding region-stabilizing sequence-poly(A)/(C) sequence-histone stem-loop-3' etc.

According to a further embodiment, the RNA, preferably an mRNA, of the present invention preferably comprises at least one of the following structural elements: a 5'- and/or 3'-untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

According to some embodiments, it is particularly preferred that—if, in addition to a peptide or protein as defined herein or a fragment or variant thereof, a further peptide or protein is encoded by the at least one coding sequence as defined herein—the encoded peptide or protein is preferably no histone protein, no reporter protein (e.g. Luciferase, GFP, EGFP, β-Galactosidase, particularly EGFP) and/or no marker or selection protein (e.g. alpha-Globin, Galactokinase and Xanthine:Guanine phosphoribosyl transferase (GPT)). In a preferred embodiment, the RNA according to the invention does not comprise a reporter gene or a marker gene. Preferably, the RNA according to the invention does not encode, for instance, luciferase; green fluorescent protein (GFP) and its variants (such as eGFP, RFP or BFP); α-globin; hypoxanthine-guanine phosphoribosyltransferase (HGPRT); β-galactosidase; galactokinase; alkaline phosphatase; secreted embryonic alkaline phosphatase (SEAP)) or a resistance gene (such as a resistance gene against neomycin, puromycin, hygromycin and zeocin). In a preferred embodiment, the RNA according to the invention does not encode luciferase. In another embodiment, the RNA according to the invention does not encode GFP or a variant thereof.

According to a preferred embodiment, the RNA according to the invention comprises, preferably in 5' to 3' direction, the following elements:

a) a 5'-cap structure, preferably m7GpppN,
b) at least one coding sequence as defined herein,
c) a 3'-UTR element comprising a nucleic acid sequence, which is derived from an α-globin gene, preferably comprising the nucleic acid sequence according to SEQ ID NO: 1444, or a homolog, a fragment or a variant thereof,
d) a poly(A) tail, preferably consisting of 10 to 200, 10 to 100, 40 to 80 or 50 to 70 adenosine nucleotides,
e) a poly(C) tail, preferably consisting of 10 to 200, 10 to 100, 20 to 70, 20 to 60 or 10 to 40 cytidine nucleotides, and
f) a histone stem-loop, preferably comprising the nucleic acid sequence according to SEQ ID NO: 1452.

In a preferred embodiment, the present invention provides an RNA comprising or consisting of a nucleic acid sequence identical to or at least 80% identical to a nucleic acid sequence selected from the group consisting of SEQ ID NO: 408 to 750, or a fragment or variant of any one of said nucleic acid sequences.

According to a further embodiment, the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 408 to 750, or a fragment or variant of any one of said nucleic acid sequences.

In another embodiment, the RNA according to the present invention comprises, preferably in 5' to 3' direction, the following elements:

a) a 5'-cap structure, preferably m7GpppN,
b) a 5'-UTR element, which comprises or consists of a nucleic acid sequence, which is derived from the 5'-UTR of a TOP gene, preferably comprising a nucleic acid sequence according to SEQ ID NO: 1432, or a homolog, a fragment or a variant thereof,
c) at least one coding sequence as defined herein,
d) a 3'-UTR element comprising a nucleic acid sequence, which is derived from an α-globin gene, preferably comprising a nucleic acid sequence according to SEQ ID NO: 1444, or a homolog, a fragment or a variant thereof; and/or
  a 3'-UTR element comprising a nucleic acid sequence, which is derived from an albumin gene, preferably comprising a nucleic acid sequence according to SEQ ID NO: 1448 or 1450, or a homolog, a fragment or a variant thereof,
e) a poly(A) tail, preferably consisting of 10 to 200, 10 to 100, 40 to 80 or 50 to 70 adenosine nucleotides,
f) a poly(C) tail, preferably consisting of 10 to 200, 10 to 100, 20 to 70, 20 to 60 or 10 to 40 cytidine nucleotides, and
g) a histone stem-loop, preferably comprising a nucleic acid sequence according to SEQ ID NO: 1452.

Preferably, the present invention provides an RNA comprising or consisting of a nucleic acid sequence identical to or at least 80% identical to a nucleic acid sequence selected from the group consisting of SEQ ID NO: 751 to 1090, or a fragment or variant of any one of said nucleic acid sequences.

In a further embodiment, the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 751 to 1090, or a fragment or variant of any one of said nucleic acid sequences.

In a further embodiment, the RNA according to the present invention comprises, preferably in 5' to 3' direction, the following elements:

a) a 5'-cap structure, preferably m7GpppN,
b) a 5'-UTR element, which comprises or consists of a nucleic acid sequence, which is derived from the 5'-UTR of the HSD17B4 gene, preferably comprising a nucleic acid sequence according to SEQ ID NO: 1436, or a homolog, a fragment or a variant thereof,
c) at least one coding sequence as defined herein,
d) a 3'-UTR element comprising a nucleic acid sequence, which is derived from an α-globin gene, preferably comprising a nucleic acid sequence according to SEQ ID NO: 1444, or a homolog, a fragment or a variant thereof; and/or
  a 3'-UTR element comprising a nucleic acid sequence, which is derived from an albumin gene, preferably comprising a nucleic acid sequence according to SEQ ID NO: 1448 or 1450, or a homolog, a fragment or a variant thereof,
e) a poly(A) tail, preferably consisting of 10 to 200, 10 to 100, 40 to 80 or 50 to 70 adenosine nucleotides.

Preferably, the present invention provides an RNA comprising or consisting of a nucleic acid sequence identical to or at least 80% identical to a nucleic acid sequence selected from the group consisting of SEQ ID NO: 1091 to 1430, or a fragment or variant of any one of said nucleic acid sequences.

In a further embodiment, the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 1091 to 1430, or a fragment or variant of any one of said nucleic acid sequences.

In an alternative embodiment, the present invention provides an RNA comprising or consisting of a nucleic acid sequence identical to or at least 80% identical to a nucleic acid sequence selected from the group consisting of SEQ ID NO: 408 to 1430, or a fragment or variant of any one of said nucleic acid sequences.

In a preferred embodiment, the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 408 to 1430, or a fragment or variant of any one of said nucleic acid sequences.

According to a particularly preferred embodiment, the present invention provides an RNA comprising or consisting of a nucleic acid sequence identical to or at least 80% identical to a nucleic acid sequence selected from the group consisting of SEQ ID NO: 36, 37, 75, 77, 78, 91, 92, 93, 94, 95, 97, 98, 99, 807, 808, 809, 810, 811, 813, 814, 815, 1095, 1096, 1131, 1133, 1134, 1187 and 1188, or a fragment or variant of any one of said nucleic acid sequences.

Preferably, the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 36, 37, 75, 77, 78, 91, 92, 93, 94, 95, 97, 98, 99, 807, 808, 809, 810, 811, 813, 814, 815, 1095, 1096, 1131, 1133, 1134, 1187 and 1188, or a fragment or variant of any one of said nucleic acid sequences.

In another embodiment, the present invention provides an RNA comprising or consisting of a nucleic acid sequence identical to or at least 80% identical to a nucleic acid sequence selected from the group consisting of SEQ ID NO: 75, 77, 78, 91, 92, 93, 94, 95, 97, 98, 99, 807, 808, 809, 810, 811, 813, 814, 815, 1131, 1133 and 1134, or a fragment or variant of any one of said nucleic acid sequences.

Preferably, the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 75, 77, 78, 91, 92, 93, 94, 95, 97, 98, 99, 807, 808, 809, 810, 811, 813, 814, 815, 1131, 1133 and 1134, or a fragment or variant of any one of said nucleic acid sequences.

The RNA according to the present invention may be prepared using any method known in the art, including synthetic methods such as e.g. solid phase RNA synthesis, as well as in vitro methods, such as RNA in vitro transcription reactions.

Preferred constructs are shown herein below in Table A.

TABLE A

Preferred constructs of the present invention.

| Organism/Species | Target (encoded antigen, gene e.g. from HGNC) | Description Sequence Type | SEQ ID NO:# |
|---|---|---|---|
| Homo sapiens | HsFGF21(L126R, P199G, A208E) | Gen5plusV2 (Design4) opt1 | SEQ ID NO: 1953 |
| Homo sapiens | HsHGF | Gen5plusV2 (Design4) opt1 | SEQ ID NO: 1954 |
| Mus musculus | MmHGF | Gen5plusV2 (Design4) opt1 | SEQ ID NO: 1955 |
| Homo sapiens | HsGFER | Gen5plusV2 (Design4) opt1 | SEQ ID NO: 1956 |
| Homo sapiens | HsTNFSF10 | Gen5plusV2 (Design4) opt1 | SEQ ID NO: 2117 |
| Homo sapiens | HsTNFSF10(95-281) | Gen5plusV2 (Design4) opt1 | SEQ ID NO: 2118 |
| Homo sapiens | HsALB(1-18)_HsTNFSF10(95-281) | Gen5plusV2 (Design4) opt1 | SEQ ID NO: 2119 |
| Homo sapiens | HsALB(1-18)_ILZ_HsTNFSF10(95-281) | Gen5plusV2 (Design4) opt1 | SEQ ID NO: 2120 |
| Rattus norvegicus | RnCebpa | Gen5plusV2 (Design4) opt1 | SEQ ID NO: 2121 |
| Rattus norvegicus | RnCebpa(15-344) | Gen5plusV2 (Design4) opt1 | SEQ ID NO: 2122 |
| Mus musculus | MmCebpa | Gen5plusV2 (Design4) opt1 | SEQ ID NO: 2123 |
| Mus musculus | MmCebpa(15-359) | Gen5plusV2 (Design4) opt1 | SEQ ID NO: 2124 |
| Homo sapiens | HsCEBPA | Gen5plusV2 (Design4) opt1 | SEQ ID NO: 2125 |
| Homo sapiens | HsCEBPA(15-358) | Gen5plusV2 (Design4) opt1 | SEQ ID NO: 2126 |
| Homo sapiens | HsHNF4A | Gen5plusV2 (Design4) opt1 | SEQ ID NO: 2127 |
| Homo sapiens | HsFGF21 | Gen5plusV2 (Design4) opt1 | SEQ ID NO: 2128 |
| Homo sapiens | HsOGFRL1 | Gen5plusV2 (Design4) opt1 | SEQ ID NO: 2129 |

TABLE A-continued

Preferred constructs of the present invention.

| Organism/Species | Target (encoded antigen, gene e.g. from HGNC) | Description Sequence Type | SEQ ID NO:# |
|---|---|---|---|
| *Homo sapiens* | HsRLN1 | Gen5plusV2 (Design4) opt1 | SEQ ID NO: 2130 |
| *Homo sapiens* | HsRLN2 | Gen5plusV2 (Design4) opt1 | SEQ ID NO: 2131 |
| *Homo sapiens* | HsRLN3 | Gen5plusV2 (Design4) opt1 | SEQ ID NO: 2132 |
| *Homo sapiens* | HsMMP1 | Gen5plusV2 (Design4) opt1 | SEQ ID NO: 2133 |
| *Homo sapiens* | HsMMP1(1-19, 100-469) | Gen5plusV2 (Design4) opt1 | SEQ ID NO: 2134 |
| *Clostridium histolyticum* | ColG | Gen5plusV2 (Design4) opt1 | SEQ ID NO: 2135 |
| *Clostridium histolyticum* | HsALB(1-18)_ColG(111-1118) | Gen5plusV2 (Design4) opt1 | SEQ ID NO: 2136 |
| *Clostridium histolyticum* | HsALB(1-18)_ColG(1-110)_CS-F_ColG(111-1118) | Gen5plusV2 (Design4) opt1 | SEQ ID NO: 2137 |
| *Clostridium histolyticum* | ColH | Gen5plusV2 (Design4) opt1 | SEQ ID NO: 2138 |
| *Clostridium histolyticum* | ColH | Gen5plusV2 (Design4) opt1 | SEQ ID NO: 2139 |
| *Clostridium histolyticum* | HsALB(1-18)_ColH(41-1021) | Gen5plusV2 (Design4) opt1 | SEQ ID NO: 2140 |
| *Clostridium histolyticum* | HsALB(1-18)_ColH(1-40)_CS-F_ColH(41-1021) | Gen5plusV2 (Design4) opt1 | SEQ ID NO: 2141 |

As apparent from numeric identifier <223> in the sequence listing, different construct designs were applied. The design of the inventive constructs as shown in the present specification and sequence listing is disclosed in Table B. Each construct as shown in the sequence listing resembles a preferred construct of the invention.

TABLE B

Description of construct design.

| Description Sequence Type | RNA generation |
|---|---|
| Gen4 (Design1) | Gen4 |
| Gen5 (Design2) | Gen5 |
| Gen5plusV1 (Design3) | Gen5+ HSD17B4(V2)-albumin7-A64-N5 |
| Gen5plusV2 (Design4) | Gen5+ HSD17B4(V2)-PSMB3-A64-N5-C30-hSL-N5 |
| Gen5plusV3 (Design5) | Gen5+ HSD17B4(V2)-PSMB3-A63 |
| Gen5plusV4 (Design6) | Gen5+ HSD17B4(V2)-PSMB3-hSL-A63 |
| Gen5plusV5 (Design7) | Gen5+ HSD17B4(V2)-RPS9-A63 |
| Gen5plusV6 (Design8) | Gen5+ HSD17B4(V2)-RPS9-hSL-A63 |
| Gen5plusV7 (Design9) | Gen5+ HSD17B4(V2)-Ndufa1-A63 |
| Gen5plusV8 (Design10) | Gen5+ HSD17B4(V2)-Ndufa1-hSL-A63 |

In a preferred embodiment, HsFGF21(L126R,P199G,A208E), HsHGF, MmHGF, HsGFER, HsTNFSF10, HsTNFSF10(95-281), HsALB(1-18)_HsTNFSF10(95-281), HsALB(1-18)_ILZ_HsTNFSF10(95-281), RnCebpa, RnCebpa(15-344), MmCebpa, MmCebpa(15-359), HsCEBPA, HsCEBPA(15-358), HsHNF4A, HsFGF21, HsOGFRL1, HsRLN1, HsRLN2, HsRLN3, HsMMP1, HsMMP1(1-19,100-469), ColG, HsALB(1-18)_ColG(111-1118), HsALB(1-18)_ColG(1-110), CS-F_ColG(111-1118), ColH, ColH, HsALB(1-18)_ColH(41-1021), HsALB(1-18)_ColH(1-40),_or CS-F_ColH(41-1021) comprise a construct design selected from the group consisting of Design1, Design2, Design3, Design4, Design5, Design6, Design7, Design8, Design9, and Design10 as mentioned in Table B and as apparent from numeric identifier <223> in the sequence listing.

In another embodiment, the preferred constructs for HsMMP1 are shown under SEQ ID NO:2073, 2100, 2101, 2133, 2158, 2183, 2208, 2233, 2258, 2283, 2308, 2333, 2358, 2383, and 2408 as apparent from numeric identifier <223>.

In another embodiment, the preferred constructs for HsMMP1(1-19,100-469) are shown under SEQ ID NO:2102, 2134, 2159, 2184, 2209, 2234, 2259, 2284, 2309, 2334, 2359, 2384, and 2409, as apparent from numeric identifier <223>.

In another embodiment, the preferred constructs for HsHGF are shown under SEQ ID NO: 1947, 1948, 1954, 1958, 1962, 1966, 1970, 1974, 1978, 1982, 1986, 1990, 1994, 1998, and 2075 as apparent from numeric identifier <223>.

In another embodiment, the preferred constructs for HsCEBPA, HsCEBPA(15-358), RnCebpa, RnCebpa(15-344), MmCebpa or MmCebpa(15-359) are shown under SEQ ID NO:2065, 2066, 2081, 2082, 2083, 2084, 2085, 2086, 2087, 2088, 2121, 2122, 2123, 2124, 2125, 2126, 2146, 2147, 2148, 2149, 2150, 2151, 2171, 2172, 2175, 2176, 2196, 2197, 2198, 2199, 2200, 2201, 2221, 2222, 2223, 2224, 2225, 2226, 2246, 2247, 2248, 2249, 2250, 2251, 2271, 2272, 2273, 2274, 2275, 2276, 2296, 2297, 2298, 2299, 2300, 2301, 2321, 2322, 2323, 2324, 2325, 2326, 2346, 2347, 2348, 2349, 2350, 2351, 2371, 2372, 2373, 2374, 2375, 2376, 2396, 2397, 2398, 2399, 2400 and 2401 as apparent from numeric identifier <223>.

In another embodiment, the preferred constructs for HsTNFSF10, HsTNFSF10(95-281), HsALB(1-18)_HsTNFSF10(95-281), or HsALB(1-18)_ILZ_HsTNFSF10(95-281) are shown under SEQ ID NO:2063, 2064, 2077, 2078, 2079, 2080, 2117, 2118, 2119, 2120, 2142, 2143, 2144, 2145, 2167, 2168, 2169, 2170, 2192, 2193, 2194, 2195, 2217, 2218, 2219, 2220, 2242, 2243, 2244, 2245, 2267, 2268, 2269, 2270, 2292, 2293, 2294, 2295, 2317, 2318, 2319, 2320, 2342, 2343, 2344, 2345, 2367, 2368, 2369, 2370, 2392, 2393, 2394, and 2395 as apparent from numeric identifier <223>.

In another embodiment, the preferred constructs for ColG, ColH, HsALB(1-18)_ColG(111-1118), HsALB(1-18)_ColG (1-110)_CS-F_ColG(111-1118), HsALB(1-18)_ColH(41-1021), HsALB(1-18)_ColH(1-40)_CS-F_ColH(41-1021) are shown under SEQ ID NO:2074, 2103, 2104, 2105, 2106, 2107, 2108, 2109, 2110, 2111, 2112, 2113, 2114, 2115, 2116, 2135, 2136, 2137, 2138, 2139, 2140, 2141, 2160, 2161, 2162, 2163, 2164, 2165, 2166, 2185, 2186, 2187, 2188, 2189, 2190, 2191, 2210, 2211, 2212, 2213, 2214, 2215, 2216, 2235, 2236, 2237, 2238, 2239, 2240, 2241, 2260, 2261, 2262, 2263, 2264, 2265, 2266, 2285, 2286, 2287, 2288, 2289, 2290, 2291, 2310, 2311, 2312, 2313, 2314, 2315, 2316, 2335, 2336, 2337, 2338, 2339, 2340, 2341, 2360, 2361, 2362, 2363, 2364, 2365, 2366, 2385, 2386, 2387, 2388, 2389, 2390, 2391, 2410, 2411, 2412, 2413, 2414, 2415, and 2416 as apparent from numeric identifier <223>.

In another embodiment, the preferred constructs for HsFGF21(L126R,P199G,A208E) are shown under SEQ ID NO:1945, 1946, 1953, 1957, 1961, 1965, 1969, 1973, 1977, 1981, 1985, 1989, 1993, and 1997 as apparent from numeric identifier <223>.

In another embodiment, the preferred constructs for HsFGF21 are shown under SEQ ID NO:2068, 2091, 2092, 2128, 2153, 2178, 2203, 2228, 2253, 2278, 2303, 2328, 2353, 2378, and 2403 as apparent from numeric identifier <223>.

Pharmaceutical Composition

In a further aspect, the present invention concerns a (pharmaceutical) composition comprising the RNA according to the invention as described herein. The (pharmaceutical) composition according to the invention thus comprises an RNA comprising at least one coding sequence, wherein the coding sequence encodes at least one peptide or protein as described herein, preferably a peptide or protein selected from the group consisting of an extracellular matrix protease, CCAAT/enhancer-binding protein alpha (CEBPA), TNF-related apoptosis-inducing ligand (TRAIL), hepatocyte nuclear factor 4 alpha (HNF4A), fibroblast growth factor 21 (FGF21), opioid growth factor receptor-like 1 (OGFRL1), Hepatocyte Growth Factor (HGF), Relaxin 1 (RLN1), Relaxin 2 (RLN2) and Relaxin 3 (RLN3), or a fragment or a variant of any of these peptides or proteins, as defined herein, and a pharmaceutically acceptable carrier. The composition according to the invention is preferably provided as a pharmaceutical composition.

With respect to the RNA comprised in the (pharmaceutical) composition, reference is made to the description of the RNA according to the invention, which applies to the (pharmaceutical) composition.

The (pharmaceutical) composition according to the invention preferably comprises at least one RNA according to the invention as described herein. In alternative embodiments, the (pharmaceutical) composition comprises at least two species of the RNA according to the invention.

In the context of the present invention, the (pharmaceutical) composition may encode one or more of the peptides or proteins defined herein, or a fragment or variant thereof. According to a preferred embodiment, the (pharmaceutical) composition encodes a combination of peptides or proteins, or fragments or variants thereof as described herein. Preferably, the (pharmaceutical) composition encodes at least two, three, four, five, six, seven, eight, nine or more peptides or proteins, or fragments or variants thereof as described herein, which are preferably selected from the group consisting of an extracellular matrix protease, preferably as described herein, CCAAT/enhancer-binding protein alpha (CEBPA), TNF-related apoptosis-inducing ligand (TRAIL), hepatocyte nuclear factor 4 alpha (HNF4A), fibroblast growth factor 21 (FGF21), opioid growth factor receptor-like 1 (OGFRL1), Hepatocyte Growth Factor (HGF), Relaxin 1 (RLN1), Relaxin 2 (RLN2) and Relaxin 3 (RLN3), or a fragment or variant thereof.

In a preferred embodiment, the (pharmaceutical) composition of the present invention may comprise at least one RNA according to the invention, wherein the at least one RNA encodes at least two, three, four, five, six, seven, eight, nine or more distinct peptides or proteins as defined herein or a fragment or variant thereof. Preferably, the (pharmaceutical) composition comprises several species, more preferably at least two, three, four, five, six, seven, eight, nine or more species, of the RNA according to the invention, wherein each RNA species encodes one of the peptides or proteins or a fragment or variant thereof as defined herein. In another embodiment, the RNA comprised in the (pharmaceutical) composition is a bi- or multicistronic RNA as defined herein, which encodes the at least two, three, four, five, six, seven, eight, nine or more distinct peptides or proteins. Mixtures between these embodiments are also envisaged, such as compositions comprising more than one RNA species, wherein at least one RNA species may be monocistronic, while at least one other RNA species may be bi- or multicistronic.

The (pharmaceutical) composition according to the present invention, preferably the at least one coding sequence of the RNA comprised therein, may thus comprise any combination of the nucleic acid sequences as defined herein.

In a preferred embodiment of the composition according to the invention, the RNA as described herein is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

In some embodiments, the RNA may be formulated as saline or lipid formulation. According to a preferred embodiment, the RNA according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the RNA according to the invention. In one embodiment the RNA according to the present invention is complexed with cationic lipids and/or neutral lipids and thereby forms liposomes, lipid nanoparticles, lipoplexes or neutral lipid-based nanoliposomes.

In a preferred embodiment, the lipid formulation is thus selected from the group consisting of liposomes, lipoplexes, copolymers such as PLGA and lipid nanoparticles.

In one preferred embodiment, a lipid nanoparticle (LNP) comprises:
  a) an RNA comprising at least one coding sequence as defined herein,
  b) a cationic lipid,
  c) an aggregation reducing agent (such as polyethylene glycol (PEG) lipid or PEG-modified lipid),
  d) optionally a non-cationic lipid (such as a neutral lipid), and
  e) optionally, a sterol.

In one embodiment, the lipid nanoparticle formulation consists of (i) at least one cationic lipid; (ii) a neutral lipid; (iii) a sterol, e.g., cholesterol; and (iv) a PEG-lipid, in a molar ratio of about 20-60% cationic lipid:5-25% neutral lipid: 25-55% sterol; 0.5-15% PEG-lipid.

In one embodiment, the nucleic acids may be formulated in an aminoalcohol lipidoid. Aminoalcohol lipidoids which may be used in the present invention may be prepared by the methods described in U.S. Pat. No. 8,450,298, herein incorporated by reference in its entirety.

Cationic Lipids

The lipid nanoparticle may include any cationic lipid suitable for forming a lipid nanoparticle. Preferably, the cationic lipid carries a net positive charge at about physiological pH.

The cationic lipid is preferably an amino lipid. As used herein, the term "amino lipid" is meant to include those lipids having one or two fatty acid or fatty alkyl chains and an amino head group (including an alkylamino or dialkylamino group) that may be protonated to form a cationic lipid at physiological pH.

The cationic lipid may be, for example, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DM A), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)-didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(dimethylamino)butanoate (DLin-M-C3-DMA), 3-((6Z,9Z,28Z,31Z)-heptatriaconta-6,9,28,31-tetraen-19-yloxy)-N,N-dimethylpropan-1-amine (MC3 Ether), 4-((6Z,9Z,28Z,31 Z)-heptatriaconta-6,9,28,31-tetraen-19-yloxy)-N,N-dimethylbutan-1-amine (MC4 Ether), or any combination of any of the foregoing.

Other cationic lipids include, but are not limited to, N,N-distearyl-N,N-dimethylammonium bromide (DDAB), 3β—(N—(N',N'-dimethylaminoethane)-carbamoyl)cholesterol (DC-Chol), N-(1-(2,3-dioleyloxy)propyl)-N-2-(sperminecarboxamido)ethyl)-N,N-dimethylammonium trifluoracetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N-(1,2-dimyristyloxyprop-3-yl)-N,N-dimethyl-N-hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL).

Other suitable cationic lipids are disclosed in International Publication Nos. WO09/086558, WO09/127060, WO10/048536, WO10/054406, WO10/088537, WO10/129709, and WO2011/153493; U.S. Patent Publication Nos. 2011/0256175, 2012/0128760, and 2012/0027803; U.S. Pat. No. 8,158,601; and Love et al, PNAS, 107(5), 1864-69, 2010. [51] Other suitable amino lipids include those having alternative fatty acid groups and other dialkylamino groups, including those in which the alkyl substituents are different (e.g., N-ethyl-N-methylamino-, and N-propyl-N-ethylamino-). In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of C14 to C22 may be used. Other scaffolds can also be used to separate the amino group and the fatty acid or fatty alkyl portion of the amino lipid.

In certain embodiments, amino or cationic lipids of the invention have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the invention.

In certain embodiments, the protonatable lipids have a pKa of the protonatable group in the range of about 4 to about 11, e.g., a pKa of about 5 to about 7.

Lipid particles preferably include two or more cationic lipids. The cationic lipids are preferably selected to contribute different advantageous properties. For example, cationic lipids that differ in properties such as amine pKa, chemical stability, half-life in circulation, half-life in tissue, net accumulation in tissue, or toxicity can be used in the lipid nanoparticle. In particular, the cationic lipids can be chosen so that the properties of the mixed-lipid particle are more desirable than the properties of a single-lipid particle of individual lipids.

The cationic lipid preferably comprises from about 20 mol % to about 70 mol % or 75 mol % or from about 45 mol % to about 65 mol % or about 20, 25, 30, 35, 40, 45, 50, 55, 60, 65, or about 70 mol % of the total lipid present in the particle. In another embodiment, the lipid nanoparticles include from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In one embodiment, the ratio of cationic lipid to nucleic acid is from about 3 to about 15, such as from about 5 to about 13 or from about 7 to about 11.

Non-Cationic Lipids

The non-cationic lipid is preferably a neutral lipid, an anionic lipid, or an amphipathic lipid. Neutral lipids, when present, can be any of a number of lipid species which exist either in an uncharged or neutral zwitterionic form at physiological pH. Such lipids include, for example, diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., lipid particle size and stability of the lipid particle in the bloodstream. Preferably, the neutral lipid is a lipid having two acyl groups (e.g., diacylphosphatidylcholine and diacylphosphatidylethanolamine). In one embodiment, the neutral lipids contain saturated fatty acids with carbon chain lengths in the range of C10 to C20. In another embodiment, neutral lipids with mono or diunsaturated fatty acids with carbon chain lengths in the range of C10 to C2o are used. Additionally, neutral lipids having mixtures of saturated and unsaturated fatty acid chains can be used.

Suitable neutral lipids include, but are not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), dimyristoyl phosphatidylcholine (DMPC), distearoyl-phosphatidyl-ethanolamine (DSPE), SM, 16-O-monomethyl PE, 16-O-dimethyl PE, 18-1-trans PE, 1-stearoyl-2-oleoyl-phosphatidyethanolamine (SOPE), cholesterol, or a mixture thereof. Anionic lipids suitable for use in lipid particles of the invention include, but are not limited to, phosphatidylglycerol, cardiolipin, diacylphosphatidylserine, diacylphosphatidic acid, N-dodecanoyl phosphatidylethanoloamine, N-succinyl phosphatidylethanolamine, N-glutaryl phosphatidylethanolamine, lysylphosphatidylglycerol, and other anionic modifying groups joined to neutral lipids.

The term "amphipathic lipid(s)" refers to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatdylcholine, lysophosphatidylcholine, lysophosphatidylethanolamine, dipalmitoylphosphatidylcholine, dioleoylphosphatidylcholine, distearoylphosphatidylcholine, or dilinoleoylphosphatidylcholine. Other phosphorus-lacking compounds, such as sphingolipids, glycosphingolipid families, diacylglycerols, and β-acyloxyacids, can also be used.

The non-cationic lipid is preferably from about 5 mol % to about 90 mol %, about 5 mol % to about 10 mol %, about 5, 10, 15, 20, 25, 30, 35, 40, 45, 50, 55, 60, 65, 70, 75, 80, 85, or about 90 mol % of the total lipid present in the particle. In one embodiment, the lipid nanoparticles include from about 0% to about 15% or 45% on a molar basis of neutral lipid, e.g., from about 3% to about 12% or from about 5% to about 10%. For instance, the lipid nanoparticles may include about 15%, about 10%, about 7.5%, or about 7.1% of neutral lipid on a molar basis (based upon 100% total moles of lipid in the lipid nanoparticle).

Sterols

A preferred sterol is cholesterol. Further sterols as known in the art are further envisaged for use in the context of the present invention.

The sterol preferably constitutes about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the lipid nanoparticles include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

Aggregation Reducing Agent

The aggregation reducing agent is preferably a lipid capable of reducing aggregation. Examples of such lipids include, but are not limited to, polyethylene glycol (PEG)-modified lipids, monosialoganglioside Gml, and polyamide oligomers (PAO) such as those described in U.S. Pat. No. 6,320,017, which is incorporated by reference in its entirety. Other compounds with uncharged, hydrophilic, steric-barrier moieties, which prevent aggregation during formulation, like PEG, Gml or ATTA, can also be coupled to lipids. ATTA-lipids are described, e.g., in U.S. Pat. No. 6,320,017, and PEG-lipid conjugates are described, e.g., in U.S. Pat. Nos. 5,820,873, 5,534,499 and 5,885,613, each of which is incorporated by reference in its entirety.

The aggregation reducing agent may be, for example, a polyethyleneglycol (PEG)-lipid including, without limitation, a PEG-diacylglycerol (DAG), a PEG-dialkylglycerol, a PEG-dialkyloxypropyl (DAA), a PEG-phospholipid, a PEG-ceramide (Cer), or a mixture thereof (such as PEG-Cer14 or PEG-Cer20). The PEG-DAA conjugate may be, for example, a PEG-dilauryloxypropyl (C12), a PEG-dimyristyloxypropyl (C14), a PEG-dipalmityloxypropyl (C16), or a PEG-distearyloxypropyl (C18). Other pegylated-lipids include, but are not limited to, polyethylene glycol-didimyristoyl glycerol (C14-PEG or PEG-C14, where PEG has an average molecular weight of 2000 Da) (PEG-DMG); (R)-2,3-bis(octadecyloxy)propyl-1-(methoxy poly(ethylene glycol)2000)propylcarbamate) (PEG-DSG); PEG-carbamoyl-1,2-dimyristyloxypropylamine, in which PEG has an average molecular weight of 2000 Da (PEG-cDMA); N-Acetylgalactosamine-((R)-2,3-bis(octadecyloxy)propyl-1-(methoxy poly(ethylene glycol)2000)propylcarbamate)) (GalNAc-PEG-DSG); mPEG (mw2000)-diastearoylphosphatidyl-ethanolamine (PEG-DSPE); and polyethylene glycol-dipalmitoylglycerol (PEG-DPG). In one embodiment, the aggregation reducing agent is PEG-DMG. In another embodiment, the aggregation reducing agent is PEG-c-DMA.

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28: 172-176; herein incorporated by reference in its entirety), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011

19:2186-2200; herein incorporated by reference in its entirety). In some embodiments, liposome formulations may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA in liposomes may be from about 5:1 to about 20:1, from about 10:1 to about 25:1, from about 15:1 to about 30:1 and/or at least 30:1.

The average molecular weight of the PEG moiety in the PEG-modified lipids preferably ranges from about 500 to about 8,000 Daltons (e.g., from about 1,000 to about 4,000 Daltons). In one preferred embodiment, the average molecular weight of the PEG moiety is about 2,000 Daltons.

The concentration of the aggregation reducing agent preferably ranges from about 0.1 mol % to about 15 mol %, based upon the 100% total moles of lipid in the lipid particle. In one embodiment, the formulation includes less than about 3, 2, or 1 mole percent of PEG or PEG-modified lipid, based upon the total moles of lipid in the lipid particle.

In another embodiment, the lipid nanoparticles include from about 0.1% to about 20% on a molar basis of the PEG-modified lipid, e.g., about 0.5 to about 10%, about 0.5 to about 5%, about 10%, about 5%, about 3.5%, about 1.5%, about 0.5%, or about 0.3% on a molar basis (based on 100% total moles of lipids in the lipid nanoparticle).

Lipid Nanoparticles (LNPs)

Lipid nanoparticles as used herein preferably have the structure of a liposome. A liposome is a structure having lipid-containing membranes enclosing an aqueous interior. Liposomes preferably have one or more lipid membranes. Liposomes are preferably single-layered, referred to as unilamellar, or multi-layered, referred to as multilamellar. When complexed with nucleic acids, lipid particles may also be lipoplexes, which are composed of cationic lipid bilayers sandwiched between DNA layers. Liposomes can further be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 nm and 500 nm in diameter. Liposome design preferably includes, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety. The nucleic acid may be encapsulated by the liposome and/or it may be contained in an aqueous core which may then be encapsulated by the liposome (see International Pub. Nos. WO2012/031046, WO2012/031043, WO2012/030901 and WO2012/006378 and US Patent Publication No. US20130189351, US20130195969 and US20130202684; the contents of each of which are herein incorporated by reference in their entirety).

In another embodiment, the RNA is preferably formulated in a cationic oil-in-water emulsion where the emulsion particle comprises an oil core and a cationic lipid which can interact with the polynucleotide anchoring the molecule to the emulsion particle (see International Pub. No. WO2012/006380; herein incorporated by reference in its entirety). In one embodiment, the RNA may be formulated in a water-in-oil emulsion comprising a continuous hydrophobic phase in which the hydrophilic phase is dispersed.

In one embodiment, the RNA (pharmaceutical) compositions is formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In another embodiment, the lipid nanoparticles have a median diameter size of from about 50 nm to about 300 nm, such as from about 50 nm to about 250 nm, for example, from about 50 nm to about 200 nm.

In some embodiments, the RNA is delivered using smaller LNPs. Such particles may comprise a diameter from below 0.1 μm up to 100 nm such as, but not limited to, less than 0.1 μm, less than 1.0 μm, less than 5 μm, less than 10 μm, less than 15 μm, less than 20 μm, less than 25 μm, less than 30 μm, less than 35 μm, less than 40 μm, less than 50 μm, less than 55 μm, less than 60 μm, less than 65 μm, less than 70 μm, less than 75 μm, less than 80 μm, less than 85 μm, less than 90 μm, less than 95 μm, less than 100 μm, less than 125 μm, less than 150 μm, less than 175 μm, less than 200 μm, less than 225 μm, less than 250 μm, less than 275 μm, less than 300 μm, less than 325 μm, less than 350 μm, less than 375 μm, less than 400 μm, less than 425 μm, less than 450 μm, less than 475 μm, less than 500 μm, less than 525 μm, less than 550 μm, less than 575 μm, less than 600 μm, less than 625 μm, less than 650 μm, less than 675 μm, less than 700 μm, less than 725 μm, less than 750 μm, less than 775 μm, less than 800 μm, less than 825 μm, less than 850 μm, less than 875 μm, less than 900 μm, less than 925 μm, less than 950 μm, less than 975 μm, In another embodiment, RNA is delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 nm to about 50 nm, from about 20 nm to about 50 nm, from about 30 nm to about 50 nm, from about 40 nm to about 50 nm, from about 20 nm to about 60 nm, from about 30 nm to about 60 nm, from about 40 nm to about 60 nm, from about 20 nm to about 70 nm, from about 30 nm to about 70 nm, from about 40 nm to about 70 nm, from about 50 nm to about 70 nm, from about 60 nm to about 70 nm, from about 20 nm to about 80 nm, from about 30 nm to about 80 nm, from about 40 nm to about 80 nm, from about 50 nm to about 80 nm, from about 60 nm to about 80 nm, from about 20 nm to about 90 nm, from about 30 nm to about 90 nm, from about 40 nm to about 90 nm, from about 50 nm to about 90 nm, from about 60 nm to about 90 nm and/or from about 70 nm to about 90 nm.

In one embodiment, the lipid nanoparticle has a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In yet another embodiment, the lipid nanoparticles in the formulation of the present invention have a single mode particle size distribution (i.e., they are not bi- or polymodal).

The lipid nanoparticles preferably further comprise one or more lipids and/or other components in addition to those mentioned above. Other lipids may be included in the liposome compositions for a variety of purposes, such as to prevent lipid oxidation or to attach ligands onto the liposome surface. Any of a number of lipids may be present in lipid particles, including amphipathic, neutral, cationic, and anionic lipids. Such lipids can be used alone or in combination.

Additional components that may be present in a lipid particle include bilayer stabilizing components such as polyamide oligomers (see, e.g., U.S. Pat. No. 6,320,017, which is incorporated by reference in its entirety), peptides, proteins, and detergents.

Different lipid nanoparticles having varying molar ratios of cationic lipid, non-cationic (or neutral) lipid, sterol (e.g., cholesterol), and aggregation reducing agent (such as a PEG-modified lipid) on a molar basis (based upon the total moles of lipid in the lipid nanoparticles) are provided in Table 2 below.

In one embodiment, the RNA of the present invention may be encapsulated in a therapeutic nanoparticle, referred to herein as "therapeutic nanoparticle nucleic acids." Therapeutic nanoparticles may be formulated by methods described herein and known in the art such as, but not limited to, International Pub Nos. WO2010/005740, WO2010/030763, WO2010/005721, WO2010/005723, WO2012/054923, US Pub. Nos. US20110262491, 0520100104645, US20100087337, US20100068285, US20110274759, US20100068286, US20120288541, US20130123351 and US20130230567 and U.S. Pat. Nos. 8,206,747, 8,293,276, 8,318,208 and 8,318,211; the contents of each of which are herein incorporated by reference in their entirety. In another embodiment, therapeutic polymer nanoparticles may be identified by the methods described in US Pub No. US20120140790, the contents of which is herein incorporated by reference in its entirety.

In one embodiment, the RNA according to the invention may be encapsulated in, linked to and/or associated with synthetic nanocarriers. Synthetic nanocarriers include, but are not limited to, those described in International Pub. Nos. WO2010/005740, WO2010/030763, WO2012/135010, WO2012/149252, WO2012/149255, WO2012/149259, WO2012/149265, WO2012/149268, WO2012/149282, WO2012/149301, WO2012/149393, WO2012/149405, WO2012/149411, WO2012/149454 and WO2013/019669, and US Pub. Nos. US20110262491, US20100104645, 0520100087337 and US2012244222, each of which is herein incorporated by reference in their entirety. The synthetic nanocarriers may be formulated using methods known in the art and/or described herein. As a non-limiting

TABLE 2

Exemplary lipid nanoparticle compositions

Molar Ratio of Lipids
(Based upon 100% total moles of lipid in the lipid nanoparticle)

| Formulation No. | Cationic Lipid | Non-Cationic (or Neutral) Lipid | Sterol | Aggregation Reducing Agent (e.g., PEG-lipid) |
|---|---|---|---|---|
| 1 | from about 35 to about 65% | from about 3 to about 12 or 15% | from about 15 to about 45% | from about 0.1 to about 10% (preferably from about 0.5 to about 2 or 3%) |
| 2 | from about 20 to about 70% | from about 5 to about 45% | from about 20 to about 55% | from about 0.1 to about 10% (preferably from about 0.5 to about 2 or 3%) |
| 3 | from about 45 to about 65% | from about 5 to about 10% | from about 25 to about 40% | from about 0.1 to about 3% |
| 4 | from about 20 to about 60% | from about 5 to about 25% | from about 25 to about 55% | from about 0.1 to about 5% (preferably from about 0.1 to about 3%) |
| 5 | about 40% | about 10% | about 40% | about 10% |
| 6 | about 35% | about 15% | about 40% | about 10% |
| 7 | about 52% | about 13% | about 30% | about 5% |
| 8 | about 50% | about 10% | about 38.5% | about 1.5% |

In one embodiment, the weight ratio of lipid to RNA is at least about 0.5:1, at least about 1:1, at least about 2:1, at least about 3:1, at least about 4:1, at least about 5:1, at least about 6:1, at least about 7:1, at least about 11:1, at least about 20:1, at least about 25:1, at least about 27:1, at least about 30:1, or at least about 33:1. In one embodiment, the weight ratio of lipid to RNA is from about 1:1 to about 35:1, about 3:1 to about 15:1, about 4:1 to about 15:1, or about 5:1 to about 13:1 or about 25:1 to about 33:1. In one embodiment, the weight ratio of lipid to RNA is from about 0.5:1 to about 12:1.

example, the synthetic nanocarriers may be formulated by the methods described in International Pub Nos. WO2010/005740, and WO2010/030763 and WO2012/135010 and US Pub. Nos. US20110262491, US20100104645, US20100087337 and US2012244222, each of which is herein incorporated by reference in their entirety. In another embodiment, the synthetic nanocarrier formulations may be lyophilized by methods described in International Pub. No. WO2011/072218 and U.S. Pat. No. 8,211,473; the content of each of which is herein incorporated by reference in their entirety. In yet another embodiment, formulations of the present invention, including, but not limited to, synthetic nanocarriers, may be lyophilized or reconstituted by the methods described in US Patent Publication No. US20130230568, the contents of which are herein incorporated by reference in its entirety.

In one embodiment, the RNA of the invention is formulated for delivery using the drug encapsulating microspheres described in International Patent Publication No. WO2013/063468 or U.S. Pat. No. 8,440,614, each of which is herein incorporated by reference in its entirety.

According to preferred embodiments, the RNA according to the invention may be formulated in order to target a specific tissue or organ. In particular, the RNA according to the invention or a pharmaceutical carrier formulated together with the RNA preferably forms a conjugate with a targeting group. Said targeting group preferably targets the conjugate, preferably the conjugate comprising the RNA, to a specific tissue or organ. In other words, by conjugating the RNA according to the invention with a target group (either directly by forming an RNA-target group conjugate or indirectly by forming a conjugate of a target group of a pharmaceutical carrier that is present in a complex with the RNA according to the invention), the RNA is delivered to a specific tissue or organ due to the targeting of said target group to that specific tissue or organ. Most preferably, the targeting group provides for delivery to liver tissue, preferably to liver macrophages, hepatocytes and or liver sinusoidal endothelial cells (LSEC). In this context, a targeting group is preferably selected from the group consisting of folate, GalNAc, galactose, mannose, mannose-6P, aptamers, integrin receptor ligands, chemokine receptor ligands, transferrin, biotin, serotonin receptor ligands, PSMA, endothelin, GCPII, somatostatin, LDL ligands and HDL ligands. Suitable approaches for targeted delivery to the liver, which may be applied to the RNA of the invention, are also described in Bartneck et al. (Bartneck et al.: Therapeutic targeting of liver inflammation and fibrosis by nanomedicine. Hepatobiliary Surgery and Nutrition 2014; 3(6):364-376), the disclosure of which is incorporated herein in its entirety.

In another embodiment, liposomes or LNPs may be formulated for targeted delivery. Preferably, the liposome or LNP is formulated for targeted delivery of the RNA according to the invention to the liver, preferably to liver macrophages, hepatocytes and/or liver sinusoidal endothelial cells (LSEC). The liposome or LNP used for targeted delivery may include, but is not limited to, the liposomes or LNPs described herein.

The RNA of the invention preferably forms conjugates, such as RNA covalently linked to a carrier or targeting group, preferably as described herein, in order to provide for targeted delivery. Alternatively, the RNA according to the invention may encode a fusion protein, e.g. bearing a targeting group fused to the peptide or protein as described herein, which is then targeted to a specific tissue or organ, preferably to the liver.

The conjugates preferably include targeting groups, e.g., a cell or tissue targeting agent, e.g., a lectin, glycoprotein, lipid or protein, e.g., an antibody, that binds to a specified cell type such as a liver cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups may further be proteins, e.g., glycoproteins, or peptides, e.g., molecules having a specific affinity for a co-ligand, or antibodies e.g., an antibody, that binds to a specified cell type such as a liver cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, or an activator of p38 MAP kinase.

The targeting group is preferably a ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. Preferably, the aptamer is unmodified or has any combination of modifications disclosed herein.

In a preferred embodiment, the composition according to the invention comprises the RNA according to the invention that is formulated together with a cationic or polycationic compound and/or with a polymeric carrier. Accordingly, in a further embodiment of the invention, it is preferred that the RNA as defined herein or any other nucleic acid comprised in the inventive (pharmaceutical) composition is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the RNA to the one or more polycations is in the range of about 0.1 to 10, including a range of about 0.3 to 4, of about 0.5 to 2, of about 0.7 to 2 and of about 0.7 to 1.5.

Therein, the RNA as defined herein or any other nucleic acid comprised in the (pharmaceutical) composition according to the invention can also be associated with a vehicle, transfection or complexation agent for increasing the transfection efficiency and/or the expression of the RNA according to the invention or of optionally comprised further included nucleic acids.

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila antennapedia*), pAntp, pIsl, FGF, Lactoferrin, Transportan, Buforin-2, Bac715-24, SynB, SynB(1), pVEC, hCT-derived peptides, SAP, or histones. More preferably, the RNA according to the invention is complexed with one or more polycations, preferably with protamine or oligofectamine, most preferably with protamine. In this context protamine is particularly preferred.

Additionally, preferred cationic or polycationic proteins or peptides may be selected from the following proteins or peptides having the following total formula (III):

$$(Arg)_l;(Lys)_m;(His)_n;(Orn)_o;(Xaa)_x, \quad \text{(formula (III))}$$

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO 2009/030481 is incorporated herewith by reference.

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14, O,O-ditetradecanoyl-N-(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

According to a preferred embodiment, the composition of the present invention comprises the RNA as defined herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO2012/013326 is incorporated herewith by reference.

In this context, the cationic components, which form the basis for the polymeric carrier by disulfide-crosslinkage, are typically selected from any suitable cationic or polycationic peptide, protein or polymer suitable for this purpose, particular any cationic or polycationic peptide, protein or polymer capable of complexing the RNA as defined herein or a further nucleic acid comprised in the composition, and thereby preferably condensing the RNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the RNA according to the invention or any further nucleic acid comprised in the (pharmaceutical) composition of the present invention contains at least one —SH moiety, most preferably at least one cysteine residue or any further chemical group exhibiting an —SH moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the RNA of the present invention or any further nucleic acid comprised in the (pharmaceutical) composition according to the invention may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined herein for complexation agent.

In a further particular embodiment, the polymeric carrier which may be used to complex the RNA as defined herein or any further nucleic acid comprised in the (pharmaceutical) composition according to the invention may be selected from a polymeric carrier molecule according to generic formula (IV):

$$L-P^1-S-[S-P^2-S]_n-S-P^3-L \quad \text{formula (IV)}$$

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), $(AA)_x$, or $[(AA)_x]_z$ if such components are used as a linker between $P^1$ and $P^2$ or $P^3$ and $P^2$) and/or with further components (e.g. (AA), $(AA)_x$, $[(AA)_x]_z$ or L), the linear or branched hydrophilic polymer chain selected independent from each other from polyethylene glycol (PEG), poly-N-(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethyl starch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two —SH-moieties, capable to form a disulfide linkage upon condensation with further components $P^2$ or component(s) $P^1$ and/or $P^3$ or alternatively with further components (e.g. (AA), $(AA)_x$, or $[(AA)_x]_z$);

S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^3$, or optionally of further components as defined herein (e.g. L, (AA), $(AA)_x$, $[(AA)_x]_z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO2011/026641 is incorporated herewith by reference. Each of hydrophilic polymers $P^1$ and $P^3$ typically exhibits at least one —SH-moiety, wherein the at least one —SH-moiety is capable to form a disulfide linkage upon reaction with component $P^2$ or with component (AA) or $(AA)_x$, if used as linker between $P^1$ and $P^2$ or $P^3$ and $P^2$ as defined below and optionally with a further component, e.g. L and/or (AA) or $(AA)_x$, e.g. if two or more —SH-moieties are contained. The following subformulae "$P^1$—S—S—$P^2$" and "$P^2$—S—S—$P^3$" within generic formula (IV) above (the brackets are omitted for better readability), wherein any of S, $P^1$ and $P^3$ are as defined herein, typically represent a situation, wherein one —SH-moiety of hydrophilic polymers $P^1$ and $P^3$ was condensed with one —SH-moiety of component $P^2$ of generic formula (IV) above, wherein both sulphurs of these —SH-moieties form a disulfide bond —S—S— as defined herein in formula (IV). These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH-moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "—Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^3$ may be modified with a —SH-moiety, preferably via a chemical reaction with a compound carrying a —SH-moiety, such that each of the hydrophilic polymers $P^1$ and $P^3$ carries at least one such —SH-moiety. Such a compound carrying a —SH-moiety may be e.g. an (additional) cysteine or any further (modified) amino acid, which carries a —SH-moiety. Such a compound may also be any non-amino compound or moiety, which contains or allows to introduce a —SH-moiety into hydrophilic polymers $P^1$ and $P^3$ as defined herein. Such non-amino compounds may be attached to the hydrophilic polymers $P^1$ and $P^3$ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g. maleinimide moieties, α,β-unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g. halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the —SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or (AA)$_x$, antibodies, cell penetrating peptides or enhancer peptides (e.g. TAT, KALA), etc.

Preferably, the inventive composition comprises at least one RNA as defined herein, which is complexed with one or more polycations, and at least one free RNA, wherein the at least one complexed RNA is preferably identical to the at least one free RNA. In this context, it is particularly preferred that the composition of the present invention comprises the RNA according to the invention that is complexed at least partially with a cationic or polycationic compound and/or a polymeric carrier, preferably cationic proteins or peptides. In this context, the disclosure of WO2010/037539 and WO2012/113513 is incorporated herewith by reference. Partially means that only a part of the RNA as defined herein is complexed in the composition according to the invention with a cationic compound and that the rest of the RNA as defined herein is (comprised in the inventive (pharmaceutical) composition) in uncomplexed form ("free"). Preferably, the molar ratio of the complexed RNA to the free RNA is selected from a molar ratio of about 0.001:1 to about 1:0.001, including a ratio of about 1:1. More preferably the ratio of complexed RNA to free RNA (in the (pharmaceutical) composition of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA in the inventive pharmaceutical composition is selected from a ratio of about 1:1 (w/w).

The complexed RNA in the (pharmaceutical) composition according to the present invention, is preferably prepared according to a first step by complexing the RNA according to the invention with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed RNA after complexing the RNA. Accordingly, the ratio of the RNA and the cationic or polycationic compound and/or the polymeric carrier in the component of the complexed RNA is typically selected in a range so that the RNA is entirely complexed and no free cationic or polycationic compound or polymeric carrier or only a negligibly small amount thereof remains in the composition.

Preferably the ratio of the RNA as defined herein to the cationic or polycationic compound and/or the polymeric carrier, preferably as defined herein, is selected from a range of about 6:1 (w/w) to about 0.25:1 (w/w), more preferably from about 5:1 (w/w) to about 0,5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the RNA as defined herein to the cationic or polycationic compound and/or the polymeric carrier, preferably as defined herein, in the component of the complexed mRNA, may also be calculated on the basis of the nitrogen/phosphate ratio (N/P-ratio) of the entire complex. In the context of the present invention, an N/P-ratio is preferably in the range of about 0.1 to 10, preferably in a range of about 0.3 to 4 and most preferably in a range of about 0.5 to 2 or 0.7 to 2 regarding the ratio of RNA:cationic or polycationic compound and/or polymeric carrier, preferably as defined herein, in the complex, and most preferably in a range of about 0.7 to 1.5, 0.5 to 1 or 0.7 to 1, and even most preferably in a range of about 0.3 to 0.9 or 0.5 to 0.9, preferably provided that the cationic or polycationic compound in the complex is a cationic or polycationic cationic or polycationic protein or peptide and/or the polymeric carrier as defined above.

In other embodiments, the composition according to the invention comprising the RNA as defined herein may be administered naked without being associated with any further vehicle, transfection or complexation agent.

It has to be understood and recognized, that according to the present invention, the inventive composition may comprise at least one naked RNA as defined herein, preferably an mRNA, and/or at least one formulated/complexed RNA as defined herein, preferably an mRNA, wherein every formulation and/or complexation as disclosed above may be used.

In embodiments, wherein the (pharmaceutical) composition comprises more than one RNA species, these RNA species may be provided such that, for example, two, three, four, five, six, seven, eight, nine or more separate compositions, which may contain at least one RNA species each (e.g. three distinct mRNA species), each encoding a distinct peptide or protein as defined herein or a fragment or variant thereof, are provided, which may or may not be combined. Also, the (pharmaceutical) composition may be a combination of at least two distinct compositions, each composition comprising at least one mRNA encoding at least one of the peptides or proteins defined herein. Alternatively, the (pharmaceutical) composition may be provided as a combination of at least one mRNA, preferably at least two, three, four, five, six, seven, eight, nine or more mRNAs, each encoding one of the peptides or proteins defined herein. The (pharmaceutical) composition may be combined to provide one single composition prior to its use or it may be used such that more than one administration is required to administer the distinct mRNA species encoding a certain combination of the proteins as defined herein. If the (pharmaceutical) composition contains at least one mRNA molecule, typically at least two mRNA molecules, encoding of a combination of peptides or proteins as defined herein, it may e.g. be administered by one single administration (combining all mRNA species), by at least two separate administrations. Accordingly; any combination of mono-, bi- or multicistronic mRNAs encoding a peptide or protein or any combination of peptides or proteins as defined herein (and optionally further proteins), provided as separate entities (containing one mRNA species) or as combined entity (containing more than one mRNA species), is understood as a (pharmaceutical) composition according to the present invention. According to a particularly preferred embodiment of the (pharmaceutical) composition, the at least one peptide or protein, preferably a combination of at least two, three, four, five, six, seven, eight, nine or more peptides or proteins encoded by the (pharmaceutical) composition as a whole, is provided as an individual (monocistronic) mRNA, which is administered separately.

The (pharmaceutical) composition according to the present invention may be provided in liquid and or in dry (e.g. lyophilized) form.

The (pharmaceutical) composition typically comprises a safe and effective amount of the RNA according to the invention as defined herein, encoding a peptide or protein as defined herein or a fragment or variant thereof or a combination of peptides or proteins, preferably as defined herein. As used herein, "safe and effective amount" means an amount of the RNA that is sufficient to significantly induce a positive modification of a disease or disorder as defined herein. At the same time, however, a "safe and effective amount" is small enough to avoid serious side-effects, that is to say to permit a sensible relationship between advantage and risk. The determination of these limits typically lies within the scope of sensible medical judgment. In relation to the (pharmaceutical) composition of the present invention, the expression "safe and effective amount" preferably means an amount of the RNA (and thus of the encoded peptide or protein) that is suitable for obtaining an appropriate expression level of the encoded protein(s). Such a "safe and effective amount" of the RNA of the (pharmaceutical) composition as defined herein may furthermore be selected in dependence of the type of RNA, e.g. monocistronic, bi- or even multicistronic RNA, since a bi- or even multicistronic RNA may lead to a significantly higher expression of the encoded protein(s) than the use of an equal amount of a monocistronic RNA. A "safe and effective amount" of the RNA of the (pharmaceutical) composition as defined above may furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The (pharmaceutical) composition according to the invention can be used according to the invention for human and also for veterinary medical purposes.

In a preferred embodiment, the RNA of the (pharmaceutical) composition or kit of parts according to the invention is provided in lyophilized form. Preferably, the lyophilized RNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition or the kit of parts according to the invention contains at least two, three, four, five, six, seven, eight, nine or more RNAs, preferably mRNAs, which are provided separately in lyophilized form (optionally together with at least one further additive) and which are preferably reconstituted separately in a suitable buffer (such as Ringer-Lactate solution) prior to their use so as to allow individual administration of each of the (monocistronic) RNAs.

The (pharmaceutical) composition according to the invention may typically contain a pharmaceutically acceptable carrier. The expression "pharmaceutically acceptable carrier" as used herein preferably includes the liquid or non-liquid basis of the composition. If the composition is provided in liquid form, the carrier will be water, typically pyrogen-free water; isotonic saline or buffered (aqueous) solutions, e.g phosphate, citrate etc. buffered solutions. Particularly for injection of the (pharmaceutical) composition, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the composition according to the invention are capable of being mixed with the RNA according to the invention as defined herein, in such a manner that no interaction occurs, which would substantially reduce the pharmaceutical effectiveness of the (pharmaceutical) composition according to the invention under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition according to the invention is administered. The (pharmaceutical) composition can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the (pharmaceutical) composition according to the present invention may be administered by an intradermal, subcutaneous, or intramuscular route, preferably by injection, which may be needle-free and/or needle injection. The (pharmaceutical) composition is therefore preferably formulated in liquid or solid form. The suitable amount of the (pharmaceutical) composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the (pharmaceutical) composition is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

Further additives which may be included in the (pharmaceutical) composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

In preferred embodiments, the (pharmaceutical) composition according to the invention comprises a further pharmaceutically active ingredient in addition to the RNA according to the invention. Preferably, the further pharmaceutically active ingredient is selected from compounds suitable for use in the treatment or prophylaxis of a liver disease or disorder as defined herein.

The (pharmaceutical) composition as defined herein may also be administered orally in any orally acceptable dosage form including, but not limited to, capsules, tablets, aqueous suspensions or solutions.

The (pharmaceutical) composition may also be administered topically. Suitable topical formulations are readily prepared for each of these areas or organs. For topical applications, the (pharmaceutical) composition may be formulated in a suitable ointment, containing the RNA according to the invention suspended or dissolved in one or more carriers.

According to a preferred embodiment of this aspect of the invention, the (pharmaceutical) composition according to the invention is administered via a parenteral route, preferably by injection. Preferably, the inventive composition is administered by intradermal, subcutaneous, or intramuscular injection. Any suitable injection technique known in the art may be employed, for example conventional needle injection or needle-less injection techniques, such as jet-injection.

In one embodiment, the (pharmaceutical) composition comprises at least two, three, four, five, six, seven, eight, nine or more RNAs as defined herein, each of which is preferably injected separately, preferably by needle-less injection. Alternatively, the (pharmaceutical) composition comprises at least two, three, four, five, six, seven, eight, nine or more RNAs, wherein the at least two, three, four, five, six, seven, eight, nine or more RNAs are administered, preferably by injection as defined herein, as a mixture.

Administration of the RNA as defined herein or the (pharmaceutical) composition according to the invention may be carried out in a time staggered treatment. A time staggered treatment may be e.g. administration of the RNA or the composition prior, concurrent and/or subsequent to a conventional therapy of a disease or disorder, preferably as described herein, e.g. by administration of the RNA or the composition prior, concurrent and/or subsequent to a therapy or an administration of a therapeutic agent suitable for the treatment or prophylaxis of a disease or disorder as described herein. Such time staggered treatment may be carried out using e.g. a kit, preferably a kit of parts as defined herein.

Time staggered treatment may additionally or alternatively also comprise an administration of the RNA as defined herein or the (pharmaceutical) composition according to the invention in a form, wherein the RNA encoding a peptide or protein as defined herein or a fragment or variant thereof, preferably forming part of the composition, is administered parallel, prior or subsequent to another RNA encoding a peptide or protein as defined above, preferably forming part of the same inventive composition. Preferably, the administration (of all RNAs) occurs within an hour, more preferably within 30 minutes, even more preferably within 15, 10, 5, 4, 3, or 2 minutes or even within 1 minute. Such time staggered treatment may be carried out using e.g. a kit, preferably a kit of parts as defined herein.

According to a further aspect, the present invention also provides kits, particularly kits of parts. Such kits, particularly kits of parts, typically comprise as components alone or in combination with further components as defined herein at least one inventive RNA species as defined herein, or the inventive (pharmaceutical) composition comprising the RNA according to the invention. The at least one RNA as defined herein, is optionally in combination with further components as defined herein, whereby the at least one RNA is provided separately (first part of the kit) from at least one other part of the kit comprising one or more other components. The (pharmaceutical) composition may occur in one or different parts of the kit. As an example, e.g. at least one part of the kit may comprise at least one RNA as defined herein, and at least one further part of the kit at least one other component as defined herein, e.g. at least one other part of the kit may comprise at least one (pharmaceutical) composition or a part thereof, e.g. at least one part of the kit may comprise the RNA as defined herein, at least one further part of the kit at least one other component as defined herein, at least one further part of the kit at least one component of the (pharmaceutical) composition or the (pharmaceutical) composition as a whole, and at least one further part of the kit e.g. at least one pharmaceutical carrier or vehicle, etc. In case the kit or kit of parts comprises a plurality of RNAs as described herein, one component of the kit can comprise only one, several or all RNAs comprised in the kit. In an alternative embodiment every/each RNA species may be comprised in a different/separate component of the kit such that each component forms a part of the kit. Also, more than one RNA as defined herein may be comprised in a first component as part of the kit, whereas one or more other (second, third etc.) components (providing one or more other parts of the kit) may either contain one or more than one RNA as defined herein, which may be identical or partially identical or different from the first component. The kit or kit of parts may furthermore contain technical instructions with information on the administration and dosage of the RNA according to the invention, the (pharmaceutical)

composition of the invention or of any of its components or parts, e.g. if the kit is prepared as a kit of parts.

In a further aspect, the present invention furthermore provides several applications and uses of the RNA, of the (pharmaceutical) composition or the kit of parts according to the invention. In particular, the present invention provides medical uses of the RNA according to the invention. Moreover, the use of the RNA according to the invention, of the (pharmaceutical) composition or the kit of parts according to the invention is envisaged in gene therapy.

According to one specific aspect, the present invention is directed to the first medical use of the RNA according to the invention, of the (pharmaceutical) composition or of the kit or kit of parts comprising the RNA according to the invention or a plurality of inventive RNAs as defined herein as a medicament, particularly in gene therapy, preferably for the treatment or prophylaxis of a liver disease or disorder as defined herein.

According to another aspect, the present invention is directed to the second medical use of the RNA according to the invention, of the (pharmaceutical) composition, or of the kit or kit of parts comprising the RNA according to the invention or a plurality of inventive RNAs as defined herein, for the treatment or prophylaxis of a liver disease or disorder as defined herein, preferably to the use of the RNA as defined herein, of the (pharmaceutical) composition, or the kit or kit of parts comprising the RNA according to the invention as defined herein, for the preparation of a medicament for the prophylaxis, treatment and/or amelioration of a liver disease or disorder as defined herein. Preferably, the pharmaceutical composition is used on or to be administered to a patient in need thereof for this purpose.

According to a further aspect, the RNA according to the invention or the (pharmaceutical) composition comprising the RNA according to the invention is used in the manufacture of a medicament, wherein the medicament is preferably for treatment or prophylaxis of a liver disease or disorder as defined herein.

In a preferred embodiment of the present invention, the RNA, the (pharmaceutical) composition or the kit or kit of parts as described herein is provided for use in the treatment or prophylaxis of a liver disease. Accordingly, the present invention concerns an RNA comprising at least one coding sequence, wherein the coding sequence encodes at least one peptide or protein as described herein, preferably comprising or consisting of a peptide or protein selected from the group consisting of an extracellular matrix protease, CCAAT/enhancer-binding protein alpha (CEBPA), TNF-related apoptosis-inducing ligand (TRAIL), hepatocyte nuclear factor 4 alpha (HNF4A), fibroblast growth factor 21 (FGF21), opioid growth factor receptor-like 1 (OGFRL1), Hepatocyte Growth Factor (HGF), Relaxin 1 (RLN1), Relaxin 2 (RLN2) and Relaxin 3 (RLN3), or a fragment or a variant of any of these peptides or proteins, or a (pharmaceutical) composition or kit or kit of parts comprising the RNA according to the invention, for use in the treatment or prophylaxis of a liver disease.

As used herein, the term "liver disease" or "liver disorder" typically relates to any condition, which is associated with, or which leads to structural alteration or damage of liver tissue, in particular which leads to fibrosis of the liver. In particular, a "liver disease' as used herein, such as liver fibrosis or liver cirrhosis, is a chronic disease characterized by an excess production of hepatic connective tissue, in particular by the accumulation of extracellular matrix (ECM) proteins, which is preferably caused by activated hepatic stellate cells (HSC). The process of excess production of hepatic connective tissue and/or the accumulation of extracellular matrix (ECM) proteins may also be referred to as "fibrosis". The liver diseases addressed herein may also be termed "fibrotic liver diseases".

In the context of the present invention, the term "liver disease" preferably also refers to a disease or disorder, which is capable of causing fibrosis of the liver tissue and which potentially leads to liver fibrosis, such as infectious diseases (e.g. Hepatitis B, Hepatitis C or Hepatitis D), autoimmune diseases (e.g. primary biliary cirrhosis or autoimmune hepatitis), genetic/inherited diseases (hereditary haematochromatosis, Wilson's disease, cystic fibrosis, diabetes), metabolic and/or diet-related diseases (obesity, diabetes, alcohol abuse, alcoholic liver disease, non-alcoholic fatty liver disease (NAFLD) or non-alcoholic steatohepatitis (NASH)), cancer or tumor diseases (e.g. hepatocellular carcinoma (HCC)) or other diseases such as gallstones, Budd-Chiari syndrome or primary sclerosing cholangitis.

In a preferred embodiment, the RNA according to the invention is provided for use in the treatment or prophylaxis of a liver disease, which is preferably selected from the group consisting of liver fibrosis, liver cirrhosis and liver cancer. In a preferred embodiment, the RNA according to the invention is provided for use in the treatment or prophylaxis of hepatocellular carcinoma (HCC). Most preferably, the RNA according to the invention is provided for use in the treatment or prophylaxis of liver fibrosis or liver cirrhosis.

In a preferred embodiment, the RNA as described herein or the (pharmaceutical) composition is provided for treatment or prophylaxis of a liver disease, which comprises targeted delivery of the RNA. Preferably, the RNA is targeted to the liver upon administration to a mammalian subject. Targeted delivery of the RNA according to the invention is preferably achieved by formulating the RNA in a suitable manner (e.g. as a liposome or lipid nanoparticle as described herein) and/or by administering the RNA or the (pharmaceutical) composition, respectively, according to the invention via a suitable route.

Preferably, the treatment or prophylaxis of a liver disease as described herein comprises administration of the RNA or the (pharmaceutical) composition according to the invention in any suitable manner, preferably as described herein with respect to the (pharmaceutical) composition. The description of the (pharmaceutical) composition, where appropriate, also applies to the medical use of the RNA according to the invention.

In preferred embodiments, the treatment or prophylaxis comprises administration of a further pharmaceutically active ingredient in combination with the RNA according to the invention or the (pharmaceutical) composition according to the invention. Preferably, the further pharmaceutically active ingredient is selected from compounds suitable for use in the treatment or prophylaxis of a liver disease or disorder as defined herein.

Also comprised by the present invention are methods of treating or preventing a disease or disorder, preferably a liver disease or disorder as defined herein, by administering to a subject in need thereof a pharmaceutically effective amount of the RNA or the pharmaceutical composition according to the invention. Such a method typically comprises an optional first step of preparing the RNA or the composition of the present invention, and a second step, comprising administering (a pharmaceutically effective amount of) said composition to a patient/subject in need thereof. A subject in need thereof will typically be a mammal. In the context of the present invention, the mammal is preferably selected from the group comprising, without being limited thereto, e.g. goat, cattle, swine, dog, cat, donkey, monkey, ape, a rodent such as a mouse, hamster, rabbit and, particularly, human, wherein the mammal typically suffers from a disease or disorder, preferably from a liver disease or disorder as defined herein.

According to a further aspect, the present invention also provides a method for increasing the expression of a peptide or protein as described herein comprising the steps, e.g. a) providing the RNA as defined herein or the (pharmaceutical) composition as defined herein, b) applying or administering the RNA or the composition to an expression system, e.g. to a cell-free expression system, a cell (e.g. an expression host cell or a somatic cell), a tissue or an organism. The method may be applied for laboratory, for research, for diagnostic, for commercial production of peptides or proteins and/or for therapeutic purposes. In this context, typically after preparing the RNA or the composition, it is typically applied or administered to a cell-free expression system, a cell (e.g. an expression host cell or a somatic cell), a tissue or an organism, e.g. in naked or complexed form or as a (pharmaceutical) composition as described herein, preferably via transfection or by using any of the administration modes as described herein. The method may be carried out in vitro, in vivo or ex vivo. The method may furthermore be carried out in the context of the treatment of a specific disease, preferably as defined herein.

In this context in vitro is defined herein as transfection or transduction of the RNA or the composition according to the invention into cells in culture outside of an organism; in vivo is defined herein as transfection or transduction of the RNA or the composition according to the invention into cells by application of the RNA or the composition to the whole organism or individual and ex vivo is defined herein as transfection or transduction of the RNA or the composition according to the invention into cells outside of an organism or individual and subsequent application of the transfected cells to the organism or individual.

Likewise, according to another aspect, the present invention also provides the use of the RNA or the composition according to the invention, preferably for diagnostic or therapeutic purposes, for increasing the expression of a peptide or protein as described herein, particularly in gene therapy e.g. by applying or administering the RNA or the composition, e.g. to a cell-free expression system, a cell (e.g. an expression host cell or a somatic cell), a tissue or an organism. The use may be applied for laboratory, for research, for diagnostic for commercial production of peptides or proteins and/or for therapeutic purposes, preferably for gene therapy. In this context, typically after preparing the RNA or the composition according to the invention, it is typically applied or administered to a cell-free expression system, a cell (e.g. an expression host cell or a somatic cell), a tissue or an organism, preferably in naked form or complexed form, or as a (pharmaceutical) composition as described herein, preferably via transfection or by using any of the administration modes as described herein. The use may be carried out in vitro, in vivo or ex vivo. The use may furthermore be carried out in the context of the treatment of a specific disease, preferably a liver disease or disorder as defined herein.

In yet another aspect the present invention also relates to an inventive expression system comprising the RNA according to the invention or an expression vector or plasmid comprising a corresponding nucleic acid sequence according to the first aspect of the present invention. In this context the expression system may be a cell-free expression system (e.g. an in vitro transcription/translation system), a cellular expression system (e.g. mammalian cells like CHO cells, insect cells, yeast cells, bacterial cells like *E. coli*) or organisms used for expression of peptides or proteins (e.g. plants or animals like cows).

Items

The present invention may further be characterized by the following items:

1. RNA comprising at least one coding sequence,
    wherein the coding sequence encodes at least one peptide or protein selected from the group consisting of
    an extracellular matrix protease, CCAAT/enhancer-binding protein alpha (CEBPA), TNF-related apoptosis-inducing ligand (TRAIL), hepatocyte nuclear factor 4 alpha (HNF4A), fibroblast growth factor 21 (FGF21), opioid growth factor receptor-like 1 (OGFRL1), Relaxin 1 (RLN1), Relaxin 2 (RLN2) and Relaxin 3 (RLN3), or a fragment or a variant of any of these peptides or proteins,
    for use in the treatment or prophylaxis of a liver disease.
2. The RNA for use according to item 1, wherein the RNA is an mRNA, a viral RNA or a replicon RNA.
3. The RNA for use according to item 1 or 2, wherein the RNA, preferably the coding sequence, does not comprise a chemically modified sugar, a chemically modified backbone or a chemically modified nucleobase.
4. The RNA for use according to item 3, wherein the RNA does not comprise a chemically modified nucleoside or nucleotide.
5. The RNA for use according to item 3 or 4, wherein the RNA is not chemically modified.
6. The RNA for use according to any one of the preceding items, wherein the liver disease is selected from the group consisting of liver fibrosis, liver cirrhosis and liver cancer.
7. The RNA for use according to any one of the preceding items, wherein the peptide or protein comprises an extracellular matrix protease or a fragment or variant thereof.
8. The RNA for use according to item 7, wherein the extracellular matrix protease is selected from the group consisting of bacterial collagenases and mammalian matrix metalloproteinases.
9. The RNA for use according to item 7 or 8, wherein the extracellular matrix protease is selected from matrix metalloproteinase-1, preferably human matrix metalloproteinase-1, clostridial collagenase ColG and clostridial collagenase ColH.
10. The RNA for use according to any one of items 7 to 9, wherein the peptide or protein comprises an amino acid sequence selected from the group consisting of SEQ ID NO: 20 to 28, or a fragment or variant of any one of said amino acid sequences.
11. The RNA for use according to any one of items 1 to 6, wherein the peptide or protein comprises CCAAT/enhancer-binding protein alpha (CEBPA), preferably human CEBPA, or a fragment or variant thereof.
12. The RNA for use according to item 11, wherein the peptide or protein comprises an amino acid sequence selected from the group consisting of SEQ ID NO: 8 to 13, or a fragment or variant of any one of said amino acid sequences.
13. The RNA for use according to any one of items 1 to 6, wherein the peptide or protein comprises TNF-related apoptosis-inducing ligand (TRAIL), or a fragment or variant thereof.
14. The RNA for use according to item 13, wherein the peptide or protein comprises an amino acid sequence selected from the group consisting of SEQ ID NO: 4 to 7, or a fragment or variant of any one of said amino acid sequences.

15. The RNA for use according to any one of items 1 to 6, wherein the peptide or protein is selected from the group consisting of hepatocyte nuclear factor 4 alpha (HNF4A), fibroblast growth factor 21 (FGF21), opioid growth factor receptor-like 1 (OGFRL1), Relaxin 1 (RLN1), Relaxin 2 (RLN2) and Relaxin 3 (RLN3), and wherein the peptide or protein preferably comprises an amino acid sequence selected from the group consisting of SEQ ID NO: 14 to 19, or a fragment or variant of any one of said amino acid sequences.

16. The RNA for use according to any one of items 1 to 15, wherein the at least one coding sequence of the RNA comprises a nucleic acid sequence selected from the group consisting of SEQ ID NO: 32 to 71, or a fragment or variant of any one of said nucleic acid sequences.

17. The RNA for use according to any one of items 1 to 16, wherein the RNA is mono-, bi-, or multicistronic.

18. The RNA for use according to any one of items 1 to 17, wherein the RNA is an mRNA.

19. The RNA for use according to any one of items 1 to 18, wherein the RNA is a modified RNA, preferably a stabilized RNA.

20. The RNA for use according to any one of items 1 to 19, wherein the
    the G/C content of the at least one coding sequence of the RNA is increased compared to the G/C content of the corresponding coding sequence of the corresponding wild-type RNA,
    the C content of the at least one coding sequence of the RNA is increased compared to the C content of the corresponding coding sequence of the corresponding wild-type RNA, and/or wherein
    at least one codon in the at least one coding sequence of the RNA is adapted to human codon usage, wherein the codon adaptation index (CAI) is preferably increased or maximised in the at least one coding sequence of the RNA,
    wherein the amino acid sequence encoded by the RNA is preferably not modified compared to the amino acid sequence encoded by the corresponding wild-type RNA.

21. The RNA for use according to item 20, wherein the at least one coding sequence comprises a nucleic acid sequence selected from the group consisting of SEQ ID NO: 75, 76, 77, 78, 79, 80, 81, 82, 83, 84, 85, 86, 87, 88, 89, 90, 91, 92, 93, 94, 95, 96, 97, 98, 99, 103, 104, 105, 106, 107, 108, 109, 110, 111, 112, 113, 114, 115, 116, 117, 118, 119, 120, 121, 122, 123, 124, 125, 126, 127, 131, 132, 133, 134, 135, 136, 137, 138, 139, 140, 141, 142, 143, 144, 145, 146, 147, 148, 149, 150, 151, 152, 153, 154, 155, 159, 160, 161, 162, 163, 164, 165, 166, 167, 168, 169, 170, 171, 172, 173, 174, 175, 176, 177, 178, 179, 180, 181, 182, 183, 187, 188, 189, 190, 191, 192, 193, 194, 195, 196, 197, 198, 199, 200, 201, 202, 203, 204, 205, 206, 207, 208, 209, 210, 211, 215, 216, 217, 218, 219, 220, 221, 222, 223, 224, 225, 226, 227, 228, 229, 230, 231, 232, 233, 234, 235, 236, 237, 238, 239, 243, 244, 245, 246, 247, 248, 249, 250, 251, 252, 253, 254, 255, 256, 257, 258, 259, 260, 261, 262, 263, 264, 265, 266, 267, 271, 272, 273, 274, 275, 276, 277, 278, 279, 280, 281, 282, 283, 284, 285, 286, 287, 288, 289, 290, 291, 292, 293, 294, 295, 299, 300, 301, 302, 303, 304, 305, 306, 307, 308, 309, 310, 311, 312, 313, 314, 315, 316, 317, 318, 319, 320, 321, 322, 323, 327, 328, 329, 330, 331, 332, 333, 334, 335, 336, 337, 338, 339, 340, 341, 342, 343, 344, 345, 346, 347, 348, 349, 350, 351, 355, 356, 357, 358, 359, 360, 361, 362, 363, 364, 365, 366, 367, 368, 369, 370, 371, 372, 373, 374, 375, 376, 377, 378, 379, 383, 384, 385, 386, 387, 388, 389, 390, 391, 392, 393, 394, 395, 396, 397, 398, 399, 400, 401, 402, 403, 404, 405, 406 and 407, or a fragment or variant of any one of said nucleic acid sequences.

22. The RNA for use according to any one of items 1 to 21, wherein the RNA comprises a 5'-CAP structure.

23. The RNA for use according to any one of items 1 to 22, wherein the RNA comprises a poly(A) sequence, preferably comprising 10 to 200, 10 to 100, 40 to 80 or 50 to 70 adenosine nucleotides, and/or a poly(C) sequence, preferably comprising 10 to 200, 10 to 100, 20 to 70, 20 to 60 or 10 to 40 cytidine nucleotides.

24. The RNA for use according to any one of items 1 to 23, wherein the RNA comprises at least one histone stem-loop.

25. The RNA for use according to item 24, wherein the at least one histone stem-loop comprises a nucleic acid sequence according to the following formulae (I) or (II):
    formula (I) (stem-loop sequence without stem bordering elements):

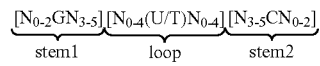

formula (II) (stem-loop sequence with stem bordering elements):

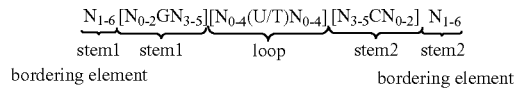

wherein:
stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;
stem1 $[N_{0-2}GN_{3-5}]$ is reverse complementary or partially reverse complementary with element stem2, and is a consecutive sequence between of 5 to 7 nucleotides;
wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;
wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and
wherein G is guanosine or an analogue thereof, and may be optionally replaced by a cytidine or an analogue thereof, provided that its complementary nucleotide cytidine in stem2 is replaced by guanosine;
loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof; and wherein C is cytidine or an analogue thereof, and may be optionally replaced by a guanosine or an analogue thereof provided that its complementary nucleotide guanosine in stem1 is replaced by cytidine;

wherein stem1 and stem2 are capable of base pairing with each other forming a reverse complementary sequence, wherein base pairing may occur between stem1 and stem2, or forming a partially reverse complementary sequence, wherein an incomplete base pairing may occur between stem1 and stem2.

26. The RNA for use according to item 24 or 25, wherein the at least one histone stem-loop comprises a nucleic acid sequence according to the following formulae (Ia) or (IIa):

formula (Ia) (stem-loop sequence without stem bordering elements):

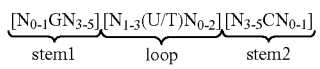

formula (IIa) (stem-loop sequence with stem bordering elements):

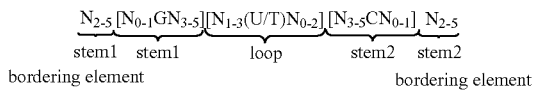

27. The RNA for use according to any one of items 24 to 26, wherein the at least one histone stem loop comprises a nucleic acid sequence according to SEQ ID NO: 1451 and most preferably a RNA sequence according to SEQ ID NO: 1452.

28. The RNA for use according to any one of items 1 to 27, wherein the RNA comprises at least one 3'-untranslated region element (3'-UTR element).

29. The RNA for use according to item 28, wherein the 3'-UTR element comprises a nucleic acid sequence derived from a 3'-UTR of a gene, which preferably encodes a stable mRNA, or from a homolog, a fragment or a variant of said gene.

30. The RNA for use according to item 29, wherein the 3'-UTR element comprises a nucleic acid sequence derived from a 3'-UTR of a gene selected from the group consisting of an albumin gene, an α-globin gene, a β-globin gene, a tyrosine hydroxylase gene, a lipoxygenase gene, and a collagen alpha gene, or from a homolog, a fragment or a variant thereof.

31. The RNA for use according to item 29 or 30, wherein the 3'-UTR element comprises a nucleic acid sequence derived from a 3'UTR of an α-globin gene, preferably comprising the nucleic acid sequence according to SEQ ID NO: 1444, a homolog, a fragment, or a variant thereof.

32. The RNA for use according to any of items 1 to 31, wherein the RNA comprises, preferably in 5' to 3' direction, the following elements:
a) a 5'-CAP structure, preferably m7GpppN,
b) at least one coding sequence as defined in item 21,
c) a 3'-UTR element comprising a nucleic acid sequence, which is derived from an α-globin gene, preferably comprising the nucleic acid sequence according to SEQ ID NO: 1444, or a homolog, a fragment or a variant thereof,
d) a poly(A) tail, preferably consisting of 10 to 200, 10 to 100, 40 to 80 or 50 to 70 adenosine nucleotides,
e) a poly(C) tail, preferably consisting of 10 to 200, 10 to 100, 20 to 70, 20 to 60 or 10 to 40 cytidine nucleotides, and
f) a histone stem-loop, preferably comprising the nucleic acid sequence according to SEQ ID NO: 1452.

33. The RNA for use according to any one of items 1 to 32, wherein the RNA comprises a nucleic acid sequence selected from the group consisting of SEQ ID NO: 408 to 750, or a fragment or variant of any one of said nucleic acid sequences.

34. The RNA for use according to any one of item 29 or 30, wherein the at least one 3'-UTR element comprises a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank Accession number NM_000477.5, or from a fragment or variant thereof.

35. The RNA for use according to item 34, wherein the 3-'UTR element comprises a nucleic acid sequence according to SEQ ID NO: 1448 or 1450, or a homolog, a fragment or a variant thereof.

36. The RNA for use according to any one of items 1 to 35, wherein the RNA comprises a 5'-UTR element.

37. The RNA for use according to item 36, wherein the 5'-UTR element comprises a nucleic acid sequence, which is derived from the 5'-UTR of a TOP gene, preferably from a corresponding RNA sequence, or a homolog, a fragment, or a variant thereof, preferably lacking the 5'TOP motif.

38. The RNA for use according to item 37, wherein the 5'-UTR element comprises a nucleic acid sequence, which is derived from a 5'-UTR of a TOP gene encoding a ribosomal protein, preferably from a corresponding RNA sequence, or from a homolog, a fragment or a variant thereof, preferably lacking the STOP motif.

39. The RNA for use according to item 37 or 38, wherein the 5'-UTR element comprises a nucleic acid sequence, which is derived from a 5'-UTR of a TOP gene encoding a ribosomal Large protein (RPL), or from a homolog, a fragment or variant thereof, preferably lacking the 5'TOP motif.
40. The RNA for use according to any one of items 37 to 39, wherein the 5'-UTR element comprises a nucleic acid sequence according to SEQ ID NO: 1432, or a homolog, a fragment or a variant thereof.
41. The RNA for use according to any one of items 1 to 40, which comprises, preferably in 5' to 3' direction, the following elements:
    a) a 5'-CAP structure, preferably m7GpppN,
    b) a 5'-UTR element, which comprises or consists of a nucleic acid sequence, which is derived from the 5'-UTR of a TOP gene, preferably comprising a nucleic acid sequence according to SEQ ID NO: 1432, or a homolog, a fragment or a variant thereof,
    c) at least one coding sequence as defined in item 21,
    d) a 3'-UTR element comprising a nucleic acid sequence, which is derived from an α-globin gene, preferably comprising a nucleic acid sequence according to SEQ ID NO: 1444, or a homolog, a fragment or a variant thereof; and/or
        a 3'-UTR element comprising a nucleic acid sequence, which is derived from an albumin gene, preferably comprising a nucleic acid sequence according to SEQ ID NO: 1448 or 1450, or a homolog, a fragment or a variant thereof,
    e) a poly(A) tail, preferably consisting of 10 to 200, 10 to 100, 40 to 80 or 50 to 70 adenosine nucleotides,
    f) a poly(C) tail, preferably consisting of 10 to 200, 10 to 100, 20 to 70, 20 to 60 or 10 to 40 cytosine nucleotides, and
    g) a histone stem-loop, preferably comprising a nucleic acid sequence according to SEQ ID NO: 1452.
42. The RNA for use according to any one of items 1 to 40, wherein the RNA comprises a nucleic acid sequence selected from the group consisting of SEQ ID NO: 751 to 1090, or a fragment or variant of any one of said nucleic acid sequences.
43. The RNA for use according to item 36, wherein the 5'-UTR element comprises a nucleic acid sequence, which is derived from the HSD17B4 gene, preferably from a corresponding RNA sequence, or a homolog, a fragment, or a variant thereof.
44. The RNA for use according to item 43, wherein the 5'-UTR element comprises a nucleic acid sequence according to SEQ ID NO: 1436, or a homolog, a fragment or a variant thereof.
45. The RNA for use according to any one of items 1 to 44, which comprises, preferably in 5' to 3' direction, the following elements:
    a) a 5'-CAP structure, preferably m7GpppN,
    b) a 5'-UTR element, which comprises or consists of a nucleic acid sequence, which is derived from the 5'-UTR of the HSD17B4 gene, preferably comprising a nucleic acid sequence according to SEQ ID NO: 1436, or a homolog, a fragment or a variant thereof,
    c) at least one coding sequence as defined in item 21,
    d) a 3'-UTR element comprising a nucleic acid sequence, which is derived from an α-globin gene, preferably comprising a nucleic acid sequence according to SEQ ID NO: 1444, or a homolog, a fragment or a variant thereof; and/or
        a 3'-UTR element comprising a nucleic acid sequence, which is derived from an albumin gene, preferably comprising a nucleic acid sequence according to SEQ ID NO: 1448 or 1450, or a homolog, a fragment or a variant thereof,
    e) a poly(A) tail, preferably consisting of 10 to 200, 10 to 100, 40 to 80 or 50 to 70 adenosine nucleotides.
46. RNA for use according to any one of items 1 to 45, wherein the RNA comprises a nucleic acid sequence selected from the group consisting of SEQ ID NO: 1091 to 1430, or a fragment or variant of any one of said nucleic acid sequences.
47. The RNA for use according to any one of items 1 to 46, wherein the RNA comprises a nucleic acid sequence selected from the group consisting of SEQ ID NO: 408 to 1430, or a fragment or variant of any one of said nucleic acid sequences.
48. The RNA for use according to any one of items 1 to 47, wherein the RNA is formulated together with at least one pharmaceutically acceptable carrier.
49. The RNA for use according to item 48, wherein the RNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids.
50. The RNA for use according to item 49, wherein the N/P ratio of the RNA to the one or more cationic or polycationic peptides or proteins is in the range of about 0.1 to 10, including a range of about 0.3 to 4, of about 0.5 to 2, of about 0.7 to 2 and of about 0.7 to 1.5.
51. The RNA for use according to any one of items 49 or 50, wherein at least one RNA is complexed with one or more cationic or polycationic compounds and at least one RNA is in a free state.
52. The RNA for use according to item 51, wherein the at least one complexed RNA is identical to the at least one free RNA.
53. The RNA for use according to item 51 or 52, wherein the molar ratio of the complexed RNA to the free RNA is selected from a molar ratio of about 0.001:1 to about 1:0.001, including a ratio of about 1:1.
54. The RNA for use according to any one of items 48 to 53, wherein the RNA is complexed with one or more lipids, thereby forming liposomes, lipid nanoparticles and/or lipoplexes.
55. The RNA for use according to any one of items 1 to 54, wherein the RNA or a pharmaceutical carrier formulated together with the RNA forms a conjugate with a targeting group.
56. The RNA for use according to item 55, wherein the targeting group provides for delivery of the conjugate to the liver, preferably to liver macrophages, hepatic stellate cells, hepatocytes and/or liver sinusoidal endothelial cells (LSEC).
57. The RNA for use according to item 55 or 56, wherein the targeting group is selected from the group consisting of folate, GalNAc, galactose, mannose, mannose-6P, aptamers, integrin receptor ligands, chemokine receptor ligands, transferrin, biotin, serotonin receptor ligands, PSMA, endothelin, GCPII, somatostatin, LDL ligands and HDL ligands.
58. The RNA for use according to any one of items 1 to 57, wherein the RNA is administered to a subject in need thereof by parenteral administration, preferably by injection.
59. The RNA for use according to any one of items 1 to 58, wherein the treatment or prophylaxis comprises administration of a further pharmaceutically active ingredient.

60. Composition comprising at least one RNA as defined according to any one of items 1 to 59 and, optionally, an additional pharmaceutically acceptable carrier.
61. Kit, preferably kit of parts, comprising at least one RNA as defined according to any one one of items 1 to 59 or the composition according to item 60, optionally a liquid vehicle for solubilising and optionally technical instructions with information on the administration and dosage of the RNA or the composition.
62. The kit according to item 61, wherein the kit contains as a part Ringer-Lactate solution.
63. The RNA as defined according to any one of items 1 to 59, the composition according to item 60, or the kit according to item 61 or 62, for use in gene therapy.
64. The RNA as defined according to any one of items 1 to 59, the composition according to item 60, or the kit according to item 61 or 62, for use in gene therapy of a liver disease.
65. Method of treating or preventing a disorder, wherein the method comprises administering to a subject in need thereof an effective amount of the RNA as defined according to any one of items 1 to 59, the composition according to item 60, or the kit according to item 61 or 62.
66. The method according to item 65, wherein the disorder is a liver disease, preferably selected from the group consisting of liver fibrosis, liver cirrhosis and liver cancer.

FIGURES

FIG. 1: Macroscopic classification of liver fibrosis in the $CCl_4$ mouse model: Representative macroscopic pictures of livers from control and $CCl_4$ treated mice. The grade of the fibrosis in the liver were classified into grade 0 (no fibrosis) to grade 3 (advanced fibrosis). Grade 0: the external surface of the liver was smooth and glistening. Grade 1: a part of the external surface of the liver (<50%) did show a structural changes such as cell dysplasia and increasing collaged deposition (scaring) of the liver. Grade 2: the majority of the external surface of the liver (>50%) did show a structural changes such as cell dysplasia and increasing collaged deposition (scaring) of the liver. Grade 3: strong macroscopic changes of the external liver surface indicated by the dysplastic nodules and strong extracellular matrix (ECM) and collagen deposition (scaring) of the liver.

Figure 2:
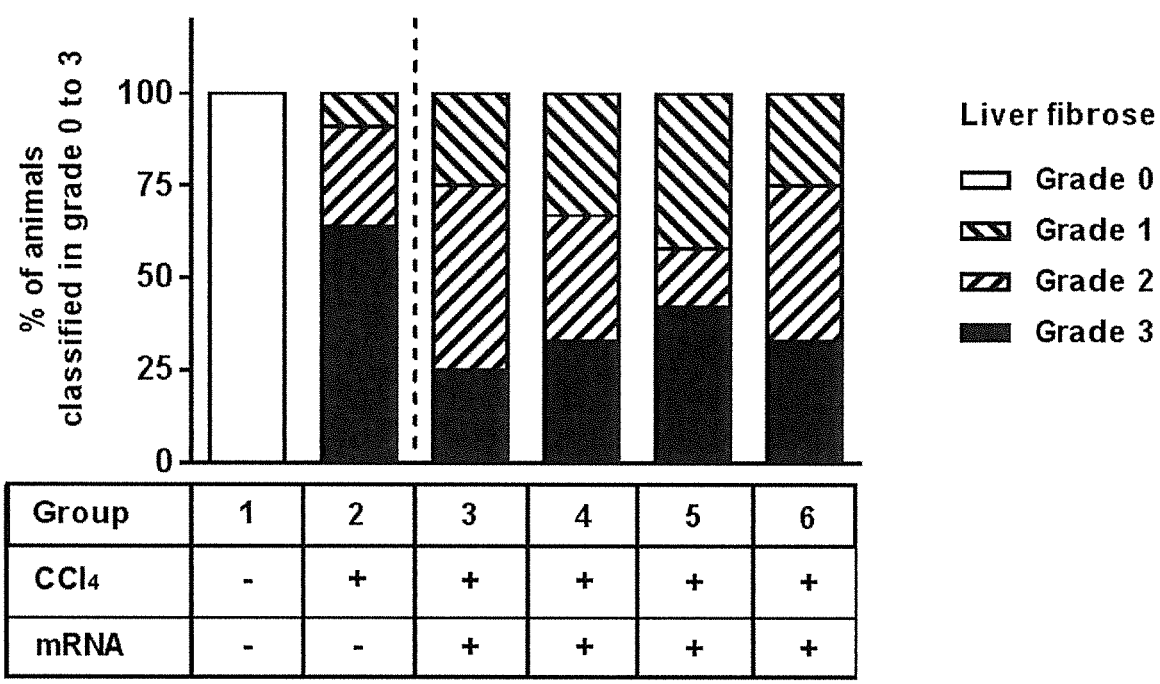

FIG. 2: Evaluation of the fibrosis stage: The liver of all animals were classified into the different grades of fibrosis according to the macroscopic classification criteria in FIG. 1 by macroscopic evaluation of the liver condition. Classification of the fibrosis: no fibrosis (Grade 0); beginning to advanced fibrosis (Grade 1 to Grade 3). mRNA treated groups (group 3 to 6) did show a reduced appearance of the Grade 3 fibrosis and a increasing appearance of the Grade 2 and 1 fibrosis compared to the mRNA untreated control group 2. The dotted line separates control groups 1-2 from treated animals groups 3-6.

Figures 3A, 3B:
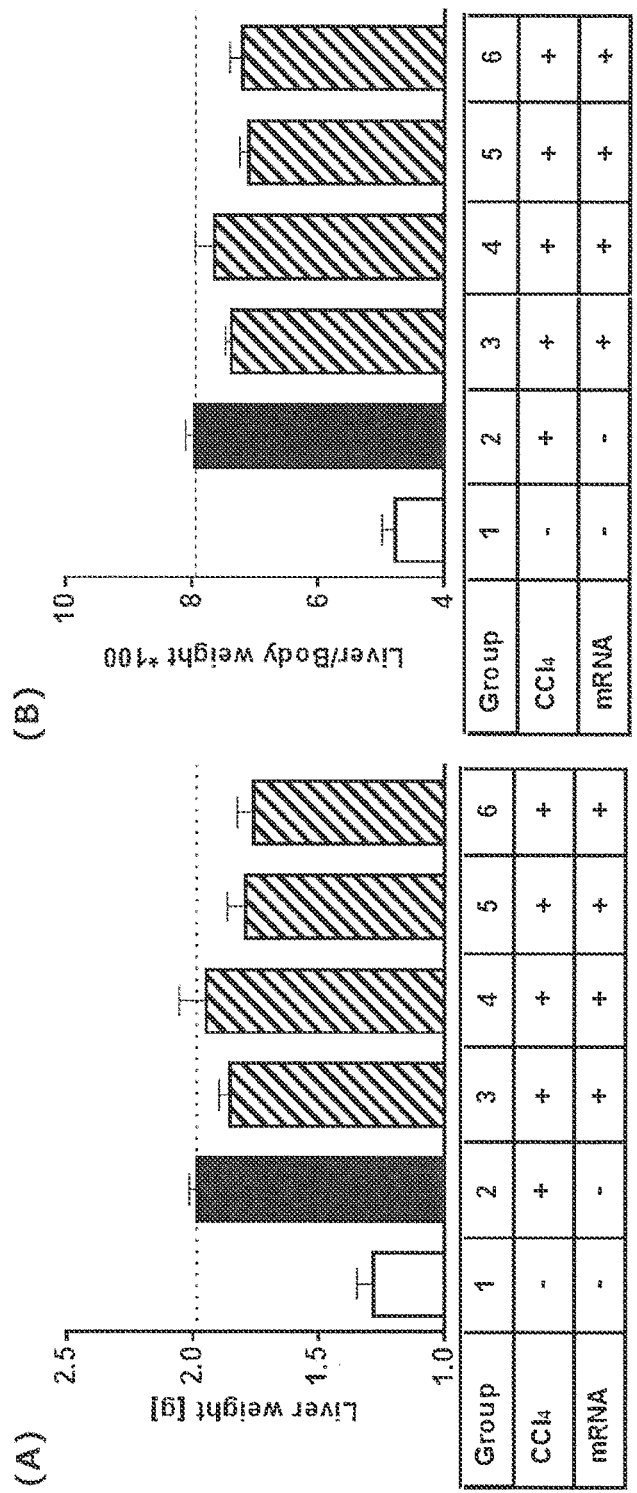

FIGS. 3(A) and 3(B): Reduction of the liver weight and the liver body weight ratio in mRNA treated animals:

FIG. 3(A) Liver weight was determined at 29 days after start of the $CCl_4$ administration (14 days after start of the mRNA treatment). mRNA treated groups (group 3 to 6) did show a lower liver weight compared to the mRNA untreated control group 2. Data (mean±SEM).

FIG. 3(B) Liver weight to body weight ratio was determined at 29 days after start of the $CCl_4$ administration (14 days after start of the mRNA treatment). The liver weight was divided by body weight and multiplied with 100 to determine the indicated ratio. mRNA treated groups (group 3 to 6) did show a lower liver weight compared to the mRNA untreated control group 2. Data (mean±SEM).

Figure 4:
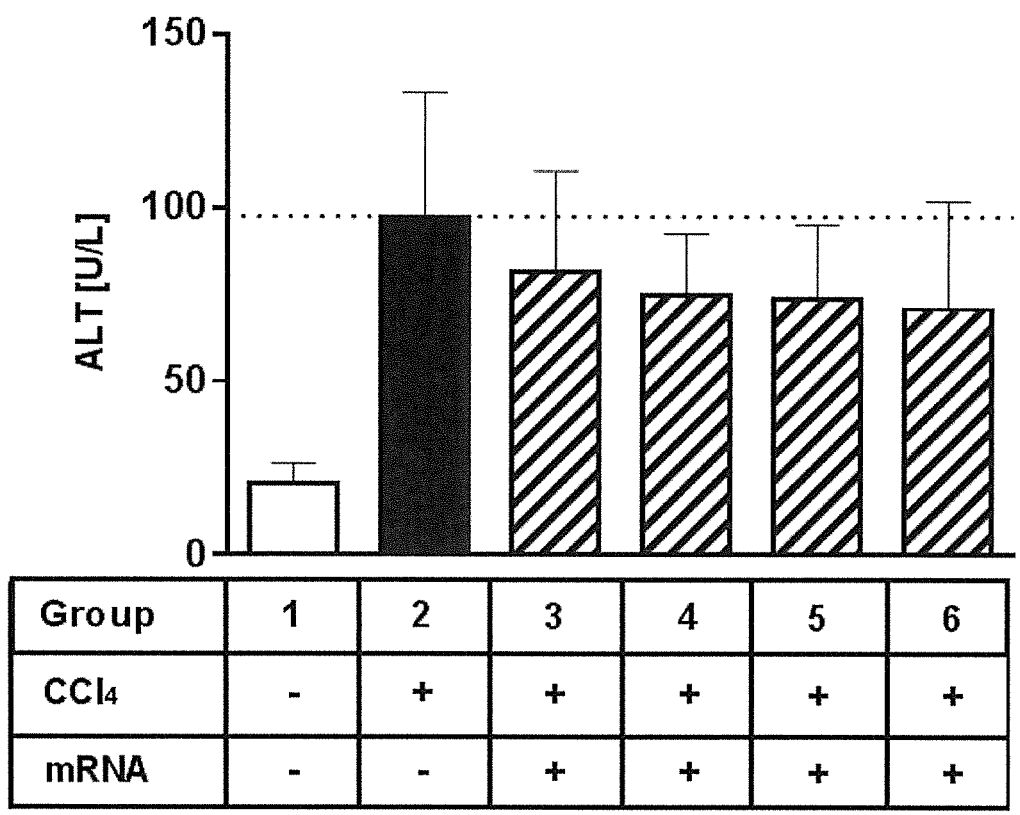

FIG. 4: Reduction of the chronic liver injury marker aminotransferase (ALT) in mRNA treated animals: Serum ALT was assessed in serum 29 days after start of the $CCl_4$ administration (14 days after start of the mRNA treatment). ALT levels were automatically determined by enzymatic analysis. mRNA treated groups (group 3 to 6) did show lower ALT levels compared to the mRNA untreated control group 2. Data (mean±SEM)

EXAMPLES

The Examples shown in the following are merely illustrative and shall describe the present invention in a further way. The Examples shall not be construed to limit the present invention thereto.

Example 1: Evaluation of the Therapeutic Efficacy of Treatment with mRNA on Carbon Tetrachloride Induced Liver Fibrosis Model in Male BALB/c Mice BALB/c mice were divided into 6 groups as apparent from the study design shown in Table 3. Induction of liver failure was achieved by $CCl_4$ administration and subsequent treatment with test compounds shows therapeutic efficacy. The administration of $CCl_4$:mineral oil was via intraperitoneal (i.p.) route twice a week for a month. As control, saline:mineral oil was administered to 5 animals (i.p.).

Bleeds via sub-mandibular route or via tail nick were scheduled on days minus 1, day 15, day 22, and a final bleed upon harvest day 29. Approximately 100 µl of whole blood was collected in serum separator tubes and serum was prepared and stored at −20° C.

For evaluation of liver function, alanine aminotransferase (ALT) was measured.

TABLE 3

Study design.

| Group | $CCl_4$ treatment[A] (i.p.) 2x/week | # of mice | Treatment (i.v.[B]) days 14, 17, 19, 21, 24 and 26 Harvest Day 29 | Formulation | RNA design | SEQ ID NO (RNA) |
|---|---|---|---|---|---|---|
| 1 | 0.9% saline:mineral oil | 5 | saline | — | — | — |
| 2 | CCl₄:mineral oil | 12 | saline | — | — | — |
| 3 | CCl₄:mineral oil | 12 | human collagenase MMP1 construct 2 (MMP1-del 20-99) | LNP | Cap1; PolyA; Hsd17B4 (V2) . . . PSBM3 . . . A64-N5-C30-histoneSL-N5(EcoR1) | 2134 |

TABLE 3-continued

Study design.

| Group | CCl₄ treatment[A] (i.p.) 2x/week | # of mice | Treatment (i.v.[B]) days 14, 17, 19, 21, 24 and 26 Harvest Day 29 | Formulation | RNA design | SEQ ID NO (RNA) |
|---|---|---|---|---|---|---|
| 4 | CCl₄:mineral oil | 12 | MmHGF-iso1 | LNP | Cap1; PolyA; Hsd17B4 (V2) . . . PSBM3 . . . A64-N5-C30-histoneSL-N5(EcoR1) | 1955 |
| 5 | CCl₄:mineral oil | 12 | MmCEBPA_Isoform 1m | LNP | Cap1; PolyA; Hsd17B4 (V2) . . . PSBM3 . . . A64-N5-C30-histoneSL-N5(EcoR1) | 2173 |
| 6 | CCl₄:mineral oil | 12 | sTRAIL construct 2 (HsALB(1-18)(GC)_ILZ(GC)_HsTNFSF10(95-281) (GC)) | LNP | Cap1; PolyA; Hsd17B4 (V2) . . . PSBM3 . . . A64-N5-C30-histoneSL-N5(EcoR1) | 2120 |
| 7 | CCl₄:mineral oil | 12 | clostridial type II collagenase (ColG + H mixture 5) | LNP | Cap1; PolyA; Hsd17B4 (V2) . . . PSBM3 . . . A64-N5-C30-histoneSL-N5(EcoR1) | 2136 + 2140 |
| 8 | CCl₄:mineral oil | 12 | FGF21 | LNP | Cap1; PolyA; Hsd17B4 (V2) . . . PSBM3 . . . A64-N5-C30-histoneSL-N5(EcoR1) | 1946 |

[A]CCL₄ or saline:mineral oil (control) was administered (i.p.) twice a week for 4 weeks;
[B]CureVac compounds or saline were administered by i.v. every 2 or 3 days beginning from day 14 post CCl₄ administration, see schedule.

The efficacy of mRNA treatment was assessed by its ability to limit the progression of disease or liver failure. For evaluation of therapeutic efficacy, 100 µl (40 µg) of LNP-formulated RNA (RNA-LNP) were injected into the animals (n=12) via intravenous route (i.v.) on days 14, 17, 19, 21, 24 and 26 post CCl₄ administration initiation:

Animals in group 1 (n=5) did serve as sham control (i.e. administration of (a) saline (i.p.) and (b) 1 ml/kg 1:1 ratio of saline:mineral oil (i.p.));

Animals in group 2 (n=12): administration of (a) saline (i.p.) (b) 1 ml/kg 1:1 ratio of CCl₄:mineral oil (i.p.);

Animals in groups 3-6 (each time: n=12): administration of (a) respective mRNA and formulation as indicated (IV) (b) 1 ml/kg 1:1 ratio of CCl₄:mineral oil (i.p.).

Final harvest was performed on day 29, i.e. 96 hours following the last CCl₄ administration, i.e. all surviving animals were weighed, the activity level was observed, blood was extracted by cardiac bleed for serum preparation, and the animals were euthanized followed by gross necropsy. Subsequently, the liver of each animal was harvested and weighed. Median lobe of the liver was fixed in 10% neutral buffered formalin for histology and remaining lobes were distributed into two tubes and snap frozen.

Representative macroscopic pictures of livers from control and CCl₄ treated mice were taken and classified into the different grades of fibrosis according to the macroscopic classification criteria in FIG. 1 (macroscopic evaluation of the liver condition). The grade of the fibrosis in the liver were classified into grade 0 (no fibrosis) to grade 3 (advanced fibrosis). Grade 0: the external surface of the liver was smooth and glistening. Grade 1: a part of the external surface of the liver (<50%) did show a structural changes such as cell dysplasia and increasing collaged deposition (scaring) of the liver. Grade 2: the majority of the external surface of the liver (>50%) did show a structural changes such as cell dysplasia and increasing collaged deposition (scaring) of the liver. Grade 3: strong macroscopic changes of the external liver surface indicated by the dysplastic nodules and strong extracellular matrix (ECM) and collagen deposition (scaring) of the liver.

Further, liver weight as indicator for liver fibrosis progression was determined at 29 days after start of the CCl₄ administration (14 days after start of the mRNA treatment; FIG. 3(A)) and liver weight to body weight ratio was determined (FIG. 3(B)). Further, according to FIG. 4, serum ALT was assessed.

Results:

All mRNA treated animals (Gr3 to Gr6) showed a lower liver weight and a lower liver/body weight ratio as compared to the control group (Gr2), FIGS. 3A and 3B, i.e. indicated an improvement or a reduced progression of the fibrosis. In addition, a lower amount of liver with a high grade of fibrosis could be observed in the mRNA treated animals (Gr3 to Gr6) as apparent from FIG. 1 and FIG. 2. Further, as apparent from FIG. 4, the fibrosis marker Alanine aminotransferase (ALT) was reduced in all mRNA treated groups compared to the control group, i.e. indicated an improvement or a reduced progression of liver fibrosis in the animals.

For further evaluation of liver function, a further enzyme panel is measured, i.e. aspartate transaminase (AST), alkaline phosphatase (ALP) and also total bilirubin (TBIL). Measurement of total bilirubin includes both unconjugated and conjugated bilirubin, as unconjugated bilirubin is a breakdown product of heme and problems with the liver are reflected as deficiencies in bilirubin metabolism (e.g., reduced hepatocyte uptake, impaired conjugation of bilirubin, and reduced hepatocyte secretion of bilirubin; examples would be cirrhosis and viral hepatitis).

Example 2: Histopathological Analysis [Prophetic]

A histopathological analysis for animals of Example 1 is performed, i.e. Sectioning and Picrosirius (PSR) staining (i.e. histological visualization of collagen I and III fibers). Furthermore, digital images of the liver of each animal are taken and additionally, scoring from standard hematoxylin-eosin (H&E) and PSR stained slides is performed. The histopathological analysis shows reduced progression of liver fibrosis.

Example 3: Evaluation of the Therapeutic Efficacy of Treatment with mRNA on Carbon Tetrachloride Induced Liver Fibrosis Model in Male BALB/c Mice [Prophetic]

BALB/c mice are divided into 17 groups as apparent from the study design shown in Table 4. Induction of liver failure is achieved by CCl₄ administration and subsequent treatment with test compounds shows therapeutic efficacy. The administration of CCl₄:mineral oil is via intraperitoneal (i.p.) route twice a week for a month. As control, saline: mineral oil is administered to 5 animals (i.p.).

Bleeds via sub-mandibular route or via tail nick are scheduled on days minus 1, day 14, day 25, and a final bleed upon harvest day 32. Approximately 100 µl of whole blood are collected in serum separator tubes and serum prepared and stored at −20° C.

For evaluation of liver function, an enzyme panel is measured, i.e. alanine aminotransferase (ALT), aspartate transaminase (AST), alkaline phosphatase (ALP) and also total bilirubin (TBIL). Further, alkaline phosphatase (ALP), gamma-glutamyl transfertase (GGT), total bilirubin (TBIL), ammonia, globulin and albumin/globulin ratio is measured. Measurement of total bilirubin includes both unconjugated and conjugated bilirubin, as unconjugated bilirubin is a breakdown product of heme and problems with the liver are reflected as deficiencies in bilirubin metabolism (e.g., reduced hepatocyte uptake, impaired conjugation of bilirubin, and reduced hepatocyte secretion of bilirubin; examples would be cirrhosis and viral hepatitis). Also, albumin levels are measured, as albumin levels are decreased in chronic liver disease, such as cirrhosis. Further, total protein (the remaining from globulins) is measured.

TABLE 4

Study design

| Group | CCl₄ treatment[A] (i.p.) 2×/week | # of mice | Treatment (i.v.[B]) days 17, 20, 24, 27 and 30, Harvest Day 32 | Formulation | SEQ ID NO (RNA) |
|---|---|---|---|---|---|
| 1 | 0.9% saline: mineral oil | 5 | saline | — | — |
| 2 | CCl₄: mineral oil | 12 | saline | — | — |
| 3 | CCl₄: mineral oil | 12 | TRAIL (HsTNFSF10) | LNP | 1131 |
| 4 | CCl₄: mineral oil | 12 | sTRAIL construct 1 (HsALB(1-18)_HsTNFSF10(95-281) (GC)) | LNP | 1133 |
| 5 | CCl₄: mineral oil | 12 | sTRAIL construct 2 (HsALB(1-18)(GC)_ILZ(GC)_HsTNFSF10(95-281)(GC)) | LNP | 1134 |
| 6 | CCl₄: mineral oil | 12 | human collagenase MMP1 construct 1 | LNP | 807 |
| 7 | CCl₄: mineral oil | 12 | human collagenase MMP1 construct 2 | LNP | 808 |
| 8 | CCl₄: mineral oil | 12 | clostridial type II collagenase (ColG) construct 1 | LNP | 809 |
| 9 | CCl₄: mineral oil | 12 | clostridial type II collagenase (ColG) construct 2 | LNP | 810 |
| 10 | CCl₄: mineral oil | 12 | clostridial type II collagenase (ColG) construct 3 | LNP | 811 |
| 11 | CCl₄: mineral oil | 12 | clostridial type II collagenase (ColH) construct 1 | LNP | 813 |
| 12 | CCl₄: mineral oil | 12 | clostridial type II collagenase (ColH) construct 2 | LNP | 814 |
| 13 | CCl₄: mineral oil | 12 | clostridial type II collagenase (ColH) construct 3 | LNP | 815 |
| 14 | CCl₄: mineral oil | 12 | clostridial type II collagenase (ColG + H mixture 1) | LNP | 809 + 813 |
| 15 | CCl₄: mineral oil | 12 | clostridial type II collagenase (ColG + H mixture 2) | LNP | 810 + 813 |
| 16 | CCl₄: mineral oil | 12 | clostridial type II collagenase (ColG + H mixture 3) | LNP | 811 + 813 |
| 17 | CCl₄: mineral oil | 12 | clostridial type II collagenase (ColG + H mixture 4) | LNP | 809 + 814 |
| 18 | CCl₄: mineral oil | 12 | clostridial type II collagenase (ColG + H mixture 5) | LNP | 810 + 814 |
| 19 | CCl₄: mineral oil | 12 | clostridial type II collagenase (ColG + H mixture 6) | LNP | 811 + 814 |
| 20 | CCl₄: mineral oil | 12 | clostridial type II collagenase (ColG + H mixture 7) | LNP | 809 + 815 |
| 21 | CCl₄: mineral oil | 12 | clostridial type II collagenase (ColG + H mixture 8) | LNP | 810 + 815 |
| 22 | CCl₄: mineral oil | 12 | clostridial type II collagenase (ColG + H mixture 9) | LNP | 811 + 815 |
| 23 | CCl₄: mineral oil | 12 | C/EBPa construct 1 | LNP | 36 |
| 24 | CCl₄: mineral oil | 12 | C/EBPa construct 2 | LNP | 37 |
| 25 | CCl₄: mineral oil | 12 | HNF4a | LNP | 1104 |
| 26 | CCl₄: mineral oil | 12 | FGF21 | LNP | 1106 |
| 27 | CCl₄: mineral oil | 12 | opioid growth factor receptor-like 1 (OGFRL1) | LNP | 1108 |
| 28 | CCl₄: mineral oil | 12 | Relaxin 1 (RLN1) | LNP | 1110 |
| 29 | CCl₄: mineral oil | 12 | Relaxin 2 (RLN2) | LNP | 1111 |
| 30 | CCl₄: mineral oil | 12 | Relaxin 3 (RLN3) | LNP | 1113 |
| 31 | CCl₄: mineral oil | 12 | Hepatocyte Growth Factor (HGF) | LNP | 1955 |
| 32 | CCl₄: mineral oil | 12 | Control LNP | LNP | — |

[A]CCL₄ or saline: mineral oil (control) is administered (i.p.) twice a week for 4 weeks;
[B]compounds or saline are administered (i.v.) every 3 or 4 days beginning from day 17 post CCl₄ administration The efficacy of mRNA treatment is assessed by its ability to limit the progression of disease or liver failure. For evaluation of therapeutic efficacy, 100 µl of LNP-formulated RNA (RNA-LNP) are injected into the animals (n=12) via intravenous route (i.v.) on days 17, 20, 24, 27 and 30 post $CCl_4$ administration initiation:

Animals in group 1 (n=5) serve as sham control (i.e. administration of (a) saline (i.p.) and (b) 1 ml/kg 1:1 ratio of saline:mineral oil (i.p.));

Animals in group 2 (n=12): administration of (a) saline (i.p.) (b) 1 ml/kg 1:1 ratio of $CCl_4$:mineral oil (i.p.);

Animals in groups 3-31 (each time: n=12): administration of (a) respective mRNA and formulation as indicated (IV) (b) 1 ml/kg 1:1 ratio of $CCl_4$:mineral oil (i.p.);

Animals in group 32 (n=12): administration of (a) Control LNP (IV) (b) 1 ml/kg 1:1 ratio of $CCl_4$:mineral oil (i.p.).

In a separate experiment, the study design of Table 4 is assessed with CVCM-formulated mRNA instead of LNP-formulated mRNA.

Final harvest is on day 32, i.e. 96 hours following the last $CCl_4$ administration, i.e. all surviving animals are weighed, the activity level is observed, blood is extracted by cardiac bleed for serum preparation, and the animals are euthanized followed by gross necropsy. Subsequently, the liver is harvested and weighed. Median lobe of the liver is fixed in 10% neutral buffered formalin for histology and remaining lobes are distributed into two tubes and snap frozen.

Collagen deposition is evaluated by hydroxyproline measurement. Also, a histopathological analysis is performed, i.e. Sectioning and Picrosirius (PSR) staining (i.e. histological visualization of collagen I and III fibers) including an αSMA staining (marker for activated hepatic stellate cells). Furthermore, digital images of the liver of each animal are taken and additionally, scoring from standard hematoxylin-eosin (H&E) and PSR stained slides is performed.

Results:

Reduction of collagen in the liver is observed in several groups. Also, a hydroxyproline reduction is observed in several groups. Further, decreased extracellular matrix deposition, including collagen and hydroxyproline content is observed for some groups. Some groups show a specific increase of apoptosis in HSCs without affecting hepatocytes. Some groups show increased survival when the animal model reached a state of liver cirrhosis.

Example 4: Evaluation of the Effect of Treatment with mRNA in a Rat Model of Carbon Tetrachloride Induced Liver Fibrosis [Prophetic]

$CCl_4$:Olive oil (1:1 ratio) is administered (i.p.) to male rats (species *Rattus norvegicus*, strain: Sprague Dawley) once in 3 days at a dose of 2 ml/kg for a period of 2 weeks (5 injections), followed by 1 ml/kg (i.p.), once in 3 days for 6 weeks. Rats are divided into 17 groups as apparent from the study design shown in Table 5. The study is terminated in week 10 (i.e., 8 weeks of $CCl_4$ treatment plus 2 weeks of treatment with mRNA).

Blood is collected on d2, d7, d10, d14 post treatment (post 8 weeks). On study termination, blood samples are collected and plasma samples are submitted for liver function tests and measurement of prothrombin time.

The efficacy of mRNA treatment is assessed by its ability to limit the progression of disease or liver failure.

TABLE 5

Study design

| No | Group | Fibrosis Induction Total of 8 weeks | # of rats | Treatment Start - week 8 | Dosing (i.v.)/ Formulation | Treatment schedule | Bleeding Liver Function Test (LFT) End - week 8 + 2 (10) | SEQ ID NO (RNA) |
|---|---|---|---|---|---|---|---|---|
| 1 | Sham Control | Olive oil 2 + 6 weeks | 5 | no | no | no | d2, d7, d10, d14 | — |
| 2 | Path Control | $CCl_4$ in Olive oil 2 + 6 weeks | 8 | no | no | no | d2, d7, d10, d14 | — |
| 3 | Test 1 | $CCl_4$ in Olive oil 2 + 6 weeks | 8 | TRAIL (HsTNFSF10) | 40 µg (40 µl)/LNP | d1; d4; d7; d10; d13 - End point d14 | d2, d7, d10, d14 | 1131 |
| 4 | Test 2 | $CCl_4$ in Olive oil 2 + 6 weeks | 8 | sTRAIL construct 1 (HsALB(1-18)_HsTNFSF10(95-281) (GC)) | 40 µg (40 µl)/LNP | d1; d4; d7; d10; d13 - End point d14 | d2, d7, d10, d14 | 1133 |
| 5 | Test 3 | $CCl_4$ in Olive oil 2 + 6 weeks | 8 | sTRAIL construct 2 (HsALB(1-18)(GC)_ILZ(GC)_HsTNFSF10(95-281) (GC)) | 40 µg (40 µl)/LNP | d1; d4; d7; d10; d13 - End point d14 | d2, d7, d10, d14 | 1134 |
| 6 | Test 4 | $CCl_4$ in Olive oil 2 + 6 weeks | 8 | human collagenase MMP1 construct 1 | 40 µg (40 µl)/LNP | d1; d4; d7; d10; d13 - End point d14 | d2, d7, d10, d14 | 807 |
| 7 | Test 5 | $CCl_4$ in Olive oil 2 + 6 weeks | 8 | human collagenase MMP1 construct 2 | 40 µg (40 µl)/LNP | d1; d4; d7; d10; d13 - End point d14 | d2, d7, d10, d14 | 808 |
| 8 | Test 6 | $CCl_4$ in Olive oil 2 + 6 weeks | 8 | clostridial type II collagenase (ColG) construct 1 | 40 µg (40 µl)/LNP | d1; d4; d7; d10; d13 - End point d14 | d2, d7, d10, d14 | 809 |
| 9 | Test 7 | $CCl_4$ in Olive oil 2 + 6 weeks | 8 | clostridial type II collagenase (ColG) construct 2 | 40 µg (40 µl)/LNP | d1; d4; d7; d10; d13 - End point d14 | d2, d7, d10, d14 | 810 |
| 10 | Test 8 | $CCl_4$ in Olive oil 2 + 6 weeks | 8 | clostridial type II collagenase (ColG) construct 3 | 40 µg (40 µl)/LNP | d1; d4; d7; d10; d13 - End point d14 | d2, d7, d10, d14 | 811 |
| 11 | Test 9 | $CCl_4$ in Olive oil 2 + 6 weeks | 8 | clostridial type II collagenase (ColH) construct 1 | 40 µg (40 µl)/LNP | d1; d4; d7; d10; d13 - End point d14 | d2, d7, d10, d14 | 813 |

TABLE 5-continued

Study design

| No | Group | Fibrosis Induction Total of 8 weeks | # of rats | Treatment Start - week 8 | Dosing (i.v.)/ Formulation | Treatment schedule End - week 8 + 2 (10) | Bleeding Liver Function Test (LFT) | SEQ ID NO (RNA) |
|---|---|---|---|---|---|---|---|---|
| 12 | Test 10 | CCl$_4$ in Olive oil 2 + 6 weeks | 8 | clostridial type II collagenase (ColH) construct 2 | 40 µg (40 µl)/LNP | d1; d4; d7; d10; d13 - End point d14 | d2, d7, d10, d14 | 814 |
| 13 | Test 11 | CCl$_4$ in Olive oil 2 + 6 weeks | 8 | clostridial type II collagenase (ColH) construct 3 | 40 µg (40 µl)/LNP | d1; d4; d7; d10; d13 - End point d14 | d2, d7, d10, d14 | 815 |
| 14 | Test 12 | CCl$_4$ in Olive oil 2 + 6 weeks | 8 | clostridial type II collagenase (ColG + H mixture 1) | 40 µg (40 µl)/LNP | d1; d4; d7; d10; d13 - End point d14 | d2, d7, d10, d14 | 809 + 813 |
| 15 | Test 13 | CCl$_4$ in Olive oil 2 + 6 weeks | 8 | clostridial type II collagenase (ColG + H mixture 2) | 40 µg (40 µl)/LNP | d1; d4; d7; d10; d13 - End point d14 | d2, d7, d10, d14 | 810 + 813 |
| 16 | Test 14 | CCl$_4$ in Olive oil 2 + 6 weeks | 8 | clostridial type II collagenase (ColG + H mixture 3) | 40 µg (40 µl)/LNP | d1; d4; d7; d10; d13 - End point d14 | d2, d7, d10, d14 | 811 + 813 |
| 17 | Test 15 | CCl$_4$ in Olive oil 2 + 6 weeks | 8 | clostridial type II collagenase (ColG + H mixture 4) | 40 µg (40 µl)/LNP | d1; d4; d7; d10; d13 - End point d14 | d2, d7, d10, d14 | 809 + 814 |
| 18 | Test 16 | CCl$_4$ in Olive oil 2 + 6 weeks | 8 | clostridial type II collagenase (ColG + H mixture 5) | 40 µg (40 µl)/LNP | d1; d4; d7; d10; d13 - End point d14 | d2, d7, d10, d14 | 810 + 814 |
| 19 | Test 17 | CCl$_4$ in Olive oil 2 + 6 weeks | 8 | clostridial type II collagenase (ColG + H mixture 6) | 40 µg (40 µl)/LNP | d1; d4; d7; d10; d13 - End point d14 | d2, d7, d10, d14 | 811 + 814 |
| 20 | Test 18 | CCl$_4$ in Olive oil 2 + 6 weeks | 8 | clostridial type II collagenase (ColG + H mixture 7) | 40 µg (40 µl)/LNP | d1; d4; d7; d10; d13 - End point d14 | d2, d7, d10, d14 | 809 + 815 |
| 21 | Test 19 | CCl$_4$ in Olive oil 2 + 6 weeks | 8 | clostridial type II collagenase (ColG + H mixture 8) | 40 µg (40 µl)/LNP | d1; d4; d7; d10; d13 - End point d14 | d2, d7, d10, d14 | 810 + 815 |
| 22 | Test 20 | CCl$_4$ in Olive oil 2 + 6 weeks | 8 | clostridial type II collagenase (ColG + H mixture 9) | 40 µg (40 µl)/LNP | d1; d4; d7; d10; d13 - End point d14 | d2, d7, d10, d14 | 811 + 815 |
| 23 | Test 21 | CCl$_4$ in Olive oil 2 + 6 weeks | 8 | C/EBPa construct 1 | 40 µg (40 µl)/LNP | d1; d4; d7; d10; d13 - End point d14 | d2, d7, d10, d14 | 36 |
| 24 | Test 22 | CCl$_4$ in Olive oil 2 + 6 weeks | 8 | C/EBPa construct 2 | 40 µg (40 µl)/LNP | d1; d4; d7; d10; d13 - End point d14 | d2, d7, d10, d14 | 37 |
| 25 | Test 23 | CCl$_4$ in Olive oil 2 + 6 weeks | 8 | HNF4a | 40 µg (40 µl)/LNP | d1; d4; d7; d10; d13 - End point d14 | d2, d7, d10, d14 | 1104 |
| 26 | Test 24 | CCl$_4$ in Olive oil 2 + 6 weeks | 8 | FGF21 | 40 µg (40 µl)/LNP | d1; d4; d7; d10; d13 - End point d14 | d2, d7, d10, d14 | 1106 |
| 27 | Test 25 | CCl$_4$ in Olive oil 2 + 6 weeks | 8 | opioidgrowth factor receptor-like 1 (OGFRL1) | 40 µg (40 µl)/LNP | d1; d4; d7; d10; d13 - End point d14 | d2, d7, d10, d14 | 1108 |
| 28 | Test 26 | CCl$_4$ in Olive oil 2 + 6 weeks | 8 | Relaxin 1 (RLN1) | 40 µg (40 µl)/LNP | d1; d4; d7; d10; d13 - End point d14 | d2, d7, d10, d14 | 1110 |
| 29 | Test 27 | CCl$_4$ in Olive oil 2 + 6 weeks | 8 | Relaxin 2 (RLN2) | 40 µg (40 µl)/LNP | d1; d4; d7; d10; d13 - End point d14 | d2, d7, d10, d14 | 1111 |
| 30 | Test 28 | CCl$_4$ in Olive oil 2 + 6 weeks | 8 | Relaxin 3 (RLN3) | 40 µg (40 µl)/LNP | d1; d4; d7; d10; d13 - End point d14 | d2, d7, d10, d14 | 1113 |
| 31 | Test 29 | CCl$_4$ in Olive oil 2 + 6 weeks | 8 | Hepatocyte Growth Factor (HGF) | 40 µg (40 µl)/LNP | d1; d4; d7; d10; d13 - End point d14 | d2, d7, d10, d14 | 1955 |
| 32 | Test 30 | CCl$_4$ in Olive oil 2 + 6 weeks | 8 | LNP Control | 40 µg (40 µl)/LNP | d1; d4; d7; d10; d13 - End point d14 | d2, d7, d10, d14 | — |

In a separate experiment, the study design of Table 5 is assessed with CVCM-formulated mRNA instead of LNP-formulated mRNA.

A liver function test is performed, i.e. alanine aminotransferase (ALT), aspartate aminotransferase (AST), alkaline phosphatase (ALP), gamma-glutamyl transfertase (GGT), total bilirubin (TBIL), total protein (TP), ammonia, albumin, globulin and albumin/globulin ratio are measured.

A portion of ~100 mg live tissue is flash frozen in liquid nitrogen and stored at −80C for hydroxyproline estimation for evaluation of collagen deposition. For the hydroxyproline assay in liver tissue, standard commercially available kits are applied, expressing the results as µg per whole liver or per g of liver.

Remaining liver tissue is fixed in 10% Neutral Buffered Formalin and sections are prepared after routine histopathological processing. The paraffin sections are stained with Masson's Trichrome staining and assessed by a pathologist for severity of liver fibrosis. Also, the Liver Function Tests as described in Example 1 are performed.

Results:

Analogous to Example 1, a collagen reduction in liver is observed in several groups. Also, a hydroxyproline reduction is observed in several groups. Further, decreased extracellular matrix deposition, including collagen and hydroxyproline content is observed for some groups.

Some groups show a specific increase of apoptosis in aHSCs without affecting hepatocytes. Some groups show increased survival when the animal model reached a state of liver cirrhosis.

SEQUENCE LISTING (2416 sequences)

SEQ ID NO: 1 - protein, 18 aa, Artificial Sequence
  derived and/or modified protein sequence (wt) from Homo sapiens__NP_000468.1__signal peptide-HsALB
MKWVTFISLLFLFSSAYS

SEQ ID NO: 2 - protein, 32 aa, Artificial Sequence
  derived and/or modified protein sequence (wt) from Artificial__1GCM_A__isoleucinze zipper-ILZ
RMKQIEDKIEEILSKIYHIENEIARIKKLIGE

SEQ ID NO: 3 - protein, 6 aa, Artificial Sequence
  derived and/or modified protein sequence (wt) from Artificial____cleavage site-Furin
RRRRKR

SEQ ID NO: 4 - protein, 281 aa, Artificial Sequence [sequence omitted]

SEQ ID NO: 5 - protein, 187 aa, Artificial Sequence
  derived and/or modified protein sequence (wt) from Homo sapiens__NP_003801.1__HsTNFSF10(95-281)
TSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 6 - protein, 205 aa, Artificial Sequence
  derived and/or modified protein sequence (wt) from Homo sapiens__NP_003801.1__HsALB(1-18)_HsTNFSF10(95-281)
MKWVTFISLLFLFSSAYSTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 7 - protein, 237 aa, Artificial Sequence
  derived and/or modified protein sequence (wt) from Homo sapiens__NP_003801.1__HsALB(1-18)_ILZ_HsTNFSF10(95-281)
MKWVTFISLLFLFSSAYSRMKQIEDKIEEILSKIYHIENEIARIKKLIGETSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 8 - protein, 358 aa, Artificial Sequence
  derived and/or modified protein sequence (wt) from Rattus norvegicus__NP_036656.1__RnCebpa
MESADFYEAEPRPPMSSHLQSPPHAPSNAAFGFPRGAGPAPPPAPPAAPEPLGGICEHETSIDISAYIDPAAFNDEFLADLFQHSRQQEKAKAAAGPAGGGGDFDYPGAPAGPGGAVMSAGAHGPPPGYGCAAAGYLDGRLEPLYERVGAPALRPLVIKQEPREEDEAKQLALAGLFPYQPPPPPPPPHPHASPAHLAAPHLQFQIAHCGQTTMHLQPGHPTPPPTPVPSPHPAPAMGAAGLPGPGGSLKGLAGPHPDLRTGGGGGGGAGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 9 - protein, 344 aa, Artificial Sequence
  derived and/or modified protein sequence (wt) from Rattus norvegicus__NP_036656.1__RnCebpa(15-344)
MSSHLQSPPHAPSNAAFGFPRGAGPAPPPAPPAAPEPLGGICEHETSIDISAYIDPAAFNDEFLADLFQHSRQQEKAKAAAGPAGGGGDFDYPGAPAGPGGAVMSAGAHGPPPGYGCAAAGYLDGRLEPLYERVGAPALRPLVIKQEPREEDEAKQLALAGLFPYQPPPPPPPPHPHASPAHLAAPHLQFQIAHCGQTTMHLQPGHPTPPPTPVPSPHPAPAMGAAGLPGPGGSLKGLAGPHPDLRTGGGGGGGAGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 10 - protein, 359 aa, Artificial Sequence
  derived and/or modified protein sequence (wt) from Mus musculus__NP_031704.2 __MmCebpa
MESADFYEVEPRPPMSSHLQSPPHAPSNAAFGFPRGAGPAPPPAPPAAPEPLGGICEHETSIDISAYIDPAAFNDEFLADLFQHSRQQEKAKAAAGPAGGGGDFDYPGAPAGPGGAVMSAGAHGPPPGYGCAAAGYLDGRLEPLYERVGAPALRPLVIKQEPREEDEAKQLALAGLFPYQPPPPPPPPHPHASPAHLAAPHLQFQIAHCGQTTMHLQPGHPTPPPTPVPSPHAAPALGAAGLPGPGSALKGLAGAHPDLRTGGGGGGSGAGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 11 - protein, 345 aa, Artificial Sequence
  derived and/or modified protein sequence (wt) from Mus musculus__NP_031704.2 __MmCebpa(15-359)
MSSHLQSPPHAPSNAAFGFPRGAGPAPPPAPPAAPEPLGGICEHETSIDISAYIDPAAFNDEFLADLFQHSRQQEKAKAAAGPAGGGGDFDYPGAPAGPGGAVMSAGAHGPPPGYGCAAAGYLDGRLEPLYERVGAPALRPLVIKQEPREEDEAKQLALAGLFPYQPPPPPPPPHPHASPAHLAAPHLQFQIAHCGQTTMHLQPGHPTPPPTPVPSPHAAPALGAAGLPGPGSALKGLAGAHPDLRTGGGGGGSGAGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 12 - protein, 358 aa, Artificial Sequence
  derived and/or modified protein sequence (wt) from Homo sapiens__NP_004355.2__HsCEBPA
MESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 13 - protein, 344 aa, Artificial Sequence
  derived and/or modified protein sequence (wt) from Homo sapiens__NP_004355.2__HsCEBPA(15-358)
MSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 14 - protein, 474 aa, Artificial Sequence
  derived and/or modified protein sequence (wt) from Homo sapiens__NP_000448.3__HsHNF4A
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 15 - protein, 209 aa, Artificial Sequence
  derived and/or modified protein sequence (wt) from Homo sapiens__NP_061986.1__HsFGF21
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 16 - protein, 451 aa, Artificial Sequence
  derived and/or modified protein sequence (wt) from Homo sapiens__NP_078852.3__HsOGFRL1
MGNLLGGVSFREPTTVEDCDSTWQTDSEPEPEEPGPGGGSEGPGQESEQPAQPPEQAGGRPGASPAPDEDAEAAGAEQGGDSTEATAKPKRSFYAARDLYKYRHQYPNFKDIRYQNDLSNLRFYKNKIPFKPDGVYIEEVLSKWKGDYEKLEHNHTYIQWLFPLREQGLNFYAKELTTYEIEEFKKTKEAIRRFLLAYKMMLEFFGIKLTDKTGNVARAVNWQERFQHLNESQHNYLRITRILKSLGELGYESFKSPLVKFILHEALVENTIPNIKQSALEYFVYTIRDRRERRKLLRFAQKHYTPSENFIWGPPRKEQSEGSKAQKMSSPLASSHNSQTSMHKKAKDSKNSSSAVHLNSKTAEDKKVAPKEPVEETDRPSPEPSNEAAKPRNTEKDSNAENMNSQPEKTVTTPTEKKESVSPENNEEGGNDNQDNENPGNTNCHDVVLVQ

SEQ ID NO: 17 - protein, 185 aa, Artificial Sequence
  derived and/or modified protein sequence (wt) from Homo sapiens__NP_008842.1__HsRLN1
MPRLFLFHLLEFCLLLNQFSRAVAAKWKDDVIKLCGRELVRAQIAICGMSTWSKRSLSQEDAPQTPRPVAEIVPSFINKDTETIIIMLEFIANLPPELKAALSERQPSLPELQQYVPALKDSNLSFEEFKKLIRNRQSEAADSNPSELKYLGLDTHSQKKRRPYVALFEKCCLIGCTKRSLAKYC

SEQ ID NO: 18 - protein, 185 aa, Artificial Sequence
  derived and/or modified protein sequence (wt) from Homo sapiens__NP_604390.1__HsRLN2
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 19 - protein, 142 aa, Artificial Sequence
  derived and/or modified protein sequence (wt) from Homo sapiens__NP_543140.1__HsRLN3
MARYMLLLLLAVWVLTGELWPGAEARAAPYGVRLCGREFIRAVIFTCGGSRWRRSDILAHEAMGDTFPDADADEDSLAGELDEAMGSSEWLALTKSPQAFYRGRPSWQGTPGVLRGSRDVLAGLSSSCCKWGCSKSEISSLC

SEQ ID NO: 20 - protein, 469 aa, Artificial Sequence
  derived and/or modified protein sequence (wt) from Homo sapiens__NP_002412.1__HsMMP1
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 21 - protein, 389 aa, Artificial Sequence
  derived and/or modified protein sequence (wt) from Homo sapiens__NP_002412.1__HsMMP1(1-19,100-469)
MHSFPPLLLLLFWGVVSHSFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 22 - protein, 1118 aa, Artificial Sequence
  derived and/or modified protein sequence (wt) from Clostridium histolyticum__BAA77453.1__ColG
MKKNILKILMDSYSKESKIQTVRRVTSVSLLAVYLTMNTSSLVLAKPIENTNDTSIKNVEKLRNAPNEENSKKVEDSKNDKVEHVKNIEEAKVEQVAPEVKSKSTLRSASIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 23 - protein, 1026 aa, Artificial Sequence
  derived and/or modified protein sequence (wt) from Clostridium histolyticum__BAA77453.1__HsALB(1-18)_ColG(111-1118)
MKWVTFISLLFLFSSAYSIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 24 - protein, 1142 aa, Artificial Sequence
  derived and/or modified protein sequence (wt) from Clostridium histolyticum__BAA77453.1__HsALB(1-18)_ColG(1-110)_CS-F_ColG(111-1 118)
MKWVTFISLLFLFSSAYSMKKNILKILMDSYSKESKIQTVRRVTSVSLLAVYLTMNTSSLVLAKPIENTNDTSIKNVEKLRNAPNEENSKKVEDSKNDKVEHVKNIEEAKVEQVAPEVKSKSTLRSASRRRRKRIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 25 - protein, 1034 aa, Artificial Sequence
  derived and/or modified protein sequence (wt) from Clostridium histolyticum__BAA34542.1__ColH
MNFLKIILNRGKTMKRKCLSKRLMLAITMATIFTVNSTLPIYAAVDKNNATAAVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 26 - protein, 1021 aa, Artificial Sequence
  derived and/or modified protein sequence (wt) from Clostridium histolyticum__BAA34542.1__ColH
MKRKCLSKRLMLAITMATIFTVNSTLPIYAAVDKNNATAAVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 27 - protein, 999 aa, Artificial Sequence
  derived and/or modified protein sequence (wt) from Clostridium histolyticum__BAA34542.1__HsALB(1-18)_ColH(41-1021)
MKWVTFISLLFLFSSAYSVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 28 - protein, 1045 aa, Artificial Sequence
  derived and/or modified protein sequence (wt) from Clostridium histolyticum__BAA34542.1__HsALB(1-18)_ColH(1-40)_CS-F_ColH(41-102 1)
MKWVTFISLLFLFSSAYSMKRKCLSKRLMLAITMATIFTVNSTLPIYAAVDKNNATAARRRRKRVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 29 - RNA, 54 nt, Artificial Sequence
  derived and/or modified CDS sequence (wt) from Homo sapiens__NP_000468.1__signal peptide-HsALB
augaaguggguaaccuuuauuucccuucuuuuucucuuuagcucggcuuauucc

SEQ ID NO: 30 - RNA, 96 nt, Artificial Sequence
  derived and/or modified CDS sequence (wt) from Artificial__1GCM_A__isoleucinze zipper-ILZ
agaaugaagcagaucgaggacaaaauugaagagauccugagcaagauuuaccacaucgaaaacgagauugccaggaucaaaaagcucauuggcgaa

SEQ ID NO: 31 - RNA, 18 nt, Artificial Sequence
  derived and/or modified CDS sequence (wt) from Artificial____cleavage site-Furin
agaaggcggcgcaagaga

SEQ ID NO: 32 - RNA, 846 nt, Artificial Sequence
  derived and/or modified CDS sequence (wt) from Homo sapiens__NP_003801.1__HsTNFSF10
auggcuaugauggagguccaggggggacccagccugggacagaccugcgugcugaucgugaucuucacagugcuccugcagucucucuguguggcuguaacuuacguguacuuuaccaacgagcugaagcagaugcaggacaaguacuccaaaaguggcauugcuuguuucuuaaaagaagaugacaguuauugggaccccaaugacgaagagaguaugaacagccccugcuggcaagucaaguggcaacuccgucagcucguuagaaagaugauuuugagaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaa

SEQ ID NO: 33 - RNA, 564 nt, Artificial Sequence
  derived and/or modified CDS sequence (wt) from Homo sapiens__NP_003801.1__HsTNFSF10(95-281)
accucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaa

SEQ ID NO: 34 - RNA, 618 nt, Artificial Sequence
  derived and/or modified CDS sequence (wt) from Homo sapiens__NP_003801.1__HsALB(1-18)_HsTNFSF10(95-281)
augaaguggguaaccuuuauuucccuucuuuuucucuuuagcucggcuuauuccaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaa

SEQ ID NO: 35 - RNA, 714 nt, Artificial Sequence
  derived and/or modified CDS sequence (wt) from Homo sapiens__NP_003801.1__HsALB(1-18)_ILZ_HsTNFSF10(95-281)
augaaguggguaaccuuuauuucccuucuuuuucucuuuagcucggcuuauuccagaaugaagcagaucgaggacaaaauugaagagauccugagcaagauuuaccacaucgaaaacgagauugccaggaucaaaaagcucauuggcgaaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaa

SEQ ID NO: 36 - RNA, 1077 nt, Artificial Sequence
  derived and/or modified CDS sequence (wt) from Rattus norvegicus__NP_036656.1__RnCebpa
auggagucggccgacuucuacgaggcggagccgcggcccccgaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcguga

SEQ ID NO: 37 - RNA, 1035 nt, Artificial Sequence
  derived and/or modified CDS sequence (wt) from Rattus norvegicus__NP_036656.1__RnCebpa(15-344)
augagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcguga

SEQ ID NO: 38 - RNA, 1080 nt, Artificial Sequence
  derived and/or modified CDS sequence (wt) from Mus musculus__NP_031704.2 __MmCebpa
auggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcguga

SEQ ID NO: 39 - RNA, 1038 nt, Artificial Sequence
  derived and/or modified CDS sequence (wt) from Mus musculus__NP_031704.2 __MmCebpa(15-359)
augagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcguga

SEQ ID NO: 40 - RNA, 1077 nt, Artificial Sequence
  derived and/or modified CDS sequence (wt) from Homo sapiens__NP_004355.2__HsCEBPA
auggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcguga

SEQ ID NO: 41 - RNA, 1035 nt, Artificial Sequence
  derived and/or modified CDS sequence (wt) from Homo sapiens__NP_004355.2__HsCEBPA
augagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcguga

SEQ ID NO: 42 - RNA, 1077 nt, Artificial Sequence
  derived and/or modified CDS sequence (wt) from Homo sapiens__NP_004355.2__HsCEBPA(15-358)
auggagucggccgacuucuacgaggcggagccgcggcccccgaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcguga

SEQ ID NO: 43 - RNA, 1035 nt, Artificial Sequence
  derived and/or modified CDS sequence (wt) from Homo sapiens__NP_004355.2__HsCEBPA(15-358)
augagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcguga

SEQ ID NO: 44 - RNA, 1425 nt, Artificial Sequence
  derived and/or modified CDS sequence (wt) from Homo sapiens__NP_000448.3__HsHNF4A
augcgacucuccaaaacccucgucgacauggacauggccgacuacagugcugcacuggacccagccuacaccacccuggaauuugagaaugugcagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccugcugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuag

SEQ ID NO: 45 - RNA, 1425 nt, Artificial Sequence
  derived and/or modified CDS sequence (wt) from Homo sapiens__NP_000448.3__HsHNF4A
augcgacucuccaaaacccucgucgacauggacauggccgacuacagugcugcacuggacccagccuacaccacccuggaauuugagaauguccagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccuccugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccagguccaggugagcuuggaggacuacaucaacgaccgccaguaugacucgcguggccgcuuuggagagcugcugcugcugcugcccaccuugcagagcaucaccuggcagaugaucgagcagauccaguucaucaagcuguucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuag

SEQ ID NO: 46 - RNA, 630 nt, Artificial Sequence
  derived and/or modified CDS sequence (wt) from Homo sapiens__NP_061986.1__HsFGF21
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccuga

SEQ ID NO: 47 - RNA, 630 nt, Artificial Sequence
  derived and/or modified CDS sequence (wt) from Homo sapiens__NP_061986.1__HsFGF21
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccuga

SEQ ID NO: 48 - RNA, 1356 nt, Artificial Sequence
  derived and/or modified CDS sequence (wt) from Homo sapiens__NP_078852.3__HsOGFRL1
augggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaauucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaauucucaaccugagaaaacaguuacuacucccacagaaaaaaaggagaguguaucuccugagaauaacgaagaagguggaaaugauaaccaagacaaugaaaauccuggaaauacaaauugccaugauguuguacuaguacaguga

SEQ ID NO: 49 - RNA, 1356 nt, Artificial Sequence
  derived and/or modified CDS sequence (wt) from Homo sapiens__NP_078852.3__HsOGFRL1
augggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaguucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaacucucaaccugagaaaacaguuacuacucccacagaaaaaaaggagaguguaucuccugagaauaacgaagaagguggaaaugauaaccaagacaaugaaaauccuggaaauacaaauugccaugauguuguacuuguacaguga

SEQ ID NO: 50 - RNA, 558 nt, Artificial Sequence
  derived and/or modified CDS sequence (wt) from Homo sapiens__NP_008842.1__HsRLN1
augccucgccuguucuuguuccaccugcuagaauucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaauucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcuga

SEQ ID NO: 51 - RNA, 558 nt, Artificial Sequence
  derived and/or modified CDS sequence (wt) from Homo sapiens__NP_008842.1__HsRLN1
augccucgccuguucuuguuccaccuccuagaguucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaguucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcuga

SEQ ID NO: 52 - RNA, 558 nt, Artificial Sequence
  derived and/or modified CDS sequence (wt) from Homo sapiens__NP_604390.1__HsRLN2
augccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcuga

SEQ ID NO: 53 - RNA, 429 nt, Artificial Sequence
  derived and/or modified CDS sequence (wt) from Homo sapiens__NP_543140.1__HsRLN3
auggccagguacaugcugcugcugcuccuggcgguaugggugcugaccggggagcuguggccgggagcugaggcccgggcagcgccuuacggggucaggcuuugcggccgagaauucauccgagcagucaucuucaccugcgggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuag

SEQ ID NO: 54 - RNA, 429 nt, Artificial Sequence
  derived and/or modified CDS sequence (wt) from Homo sapiens__NP_543140.1__HsRLN3
auggccagguacaugcugcugcugcuccuggcgguaugggugcugaccggggagcuguggccgggagcugaggcccgggcagcgccuuacggggucaggcuuugcggccgagaguucauccgagcagucaucuucaccugugggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuag

SEQ ID NO: 55 - RNA, 1410 nt, Artificial Sequence
  derived and/or modified CDS sequence (wt) from Homo sapiens__NP_002412.1__HsMMP1
augcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauuga

SEQ ID NO: 56 - RNA, 1410 nt, Artificial Sequence
  derived and/or modified CDS sequence (wt) from Homo sapiens__NP_002412.1__HsMMP1
augcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauuga

SEQ ID NO: 57 - RNA, 1170 nt, Artificial Sequence
  derived and/or modified CDS sequence (wt) from Homo sapiens__NP_002412.1__HsMMP1(1-19,100-469)
augcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauuga

SEQ ID NO: 58 - RNA, 3357 nt, Artificial Sequence
  derived and/or modified CDS sequence (wt) from Clostridium histolyticum__BAA77453.1__ColG
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 59 - RNA, 3357 nt, Artificial Sequence
  derived and/or modified CDS sequence (wt) from Clostridium histolyticum__BAA77453.1__ColG
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 60 - RNA, 3081 nt, Artificial Sequence
  derived and/or modified CDS sequence (wt) from Clostridium histolyticum__BAA77453.1__HsALB(1-18)_ColG(111-1118)
augaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 61 - RNA, 3081 nt, Artificial Sequence
  derived and/or modified CDS sequence (wt) from Clostridium histolyticum__BAA77453.1__HsALB(1-18)_ColG(111-1118)
augaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 62 - RNA, 3429 nt, Artificial Sequence
  derived and/or modified CDS sequence (wt) from Clostridium histolyticum__BAA77453.1__HsALB(1-18)_ColG(1-110)_CS-F_ColG(111-1 118)
augaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 63 - RNA, 3429 nt, Artificial Sequence
  derived and/or modified CDS sequence (wt) from Clostridium histolyticum__BAA77453.1__HsALB(1-18)_ColG(1-110)_CS-F_ColG(111-1 118)
augaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 64 - RNA, 3105 nt, Artificial Sequence
  derived and/or modified CDS sequence (wt) from Clostridium histolyticum__BAA34542.1__ColH
augaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 65 - RNA, 3105 nt, Artificial Sequence
  derived and/or modified CDS sequence (wt) from Clostridium histolyticum__BAA34542.1__ColH
augaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 66 - RNA, 3066 nt, Artificial Sequence
  derived and/or modified CDS sequence (wt) from Clostridium histolyticum__BAA34542.1__ColH
augaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 67 - RNA, 3066 nt, Artificial Sequence
  derived and/or modified CDS sequence (wt) from Clostridium histolyticum__BAA34542.1__ColH
augaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 68 - RNA, 3000 nt, Artificial Sequence
  derived and/or modified CDS sequence (wt) from Clostridium histolyticum__BAA34542.1__HsALB(1-18)_ColH(41-1021)
augaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 69 - RNA, 3000 nt, Artificial Sequence
  derived and/or modified CDS sequence (wt) from Clostridium histolyticum__BAA34542.1__HsALB(1-18)_ColH(41-1021)
augaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 70 - RNA, 3138 nt, Artificial Sequence
  derived and/or modified CDS sequence (wt) from Clostridium histolyticum__BAA34542.1__HsALB(1-18)_ColH(1-40)_CS-F_ColH(41-102 1)
augaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 71 - RNA, 3138 nt, Artificial Sequence
  derived and/or modified CDS sequence (wt) from Clostridium histolyticum__BAA34542.1__HsALB(1-18)_ColH(1-40)_CS-F_ColH(41-102 1)
augaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 72 - RNA, 54 nt, Artificial Sequence
  derived and/or modified CDS sequence (opt1) from Homo sapiens__NP_000468.1__signal peptide-HsALB
augaagugggugaccuucaucagccugcucuuccuguucuccagcgccuacucc

SEQ ID NO: 73 - RNA, 96 nt, Artificial Sequence
  derived and/or modified CDS sequence (opt1) from Artificial__1GCM_A__isoleucinze zipper-ILZ
cgcaugaagcagaucgaggacaagaucgaggagauccugagcaagaucuaccacaucgagaacgagaucgcccggaucaagaagcucaucggcgag

SEQ ID NO: 74 - RNA, 18 nt, Artificial Sequence
  derived and/or modified CDS sequence (opt1) from Artificial____cleavage site-Furin
cgccggcgccggaagcgc

SEQ ID NO: 75 - RNA, 846 nt, Artificial Sequence
  derived and/or modified CDS sequence (opt1) from Homo sapiens__NP_003801.1__HsTNFSF10
auggccaugauggaggugcagggcgggcccagccugggccagaccugcguccucaucgugaucuucaccgugcugcugcagucccucugcgucgccgugacguacguguacuucaccaacgagcugaagcagaugcaggacaaguacagcaaguccgggaucgcgugcuuccugaaggaggacgacagcuacugggacccgaacgacgaggaguccaugaacagcccgugcuggcaggucaaguggcagcuccgccagcuggugcggaagaugauccugcgcaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucggguga

SEQ ID NO: 76 - RNA, 564 nt, Artificial Sequence
  derived and/or modified CDS sequence (opt1) from Homo sapiens__NP_003801.1__HsTNFSF10(95-281)
accuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucggguga

SEQ ID NO: 77 - RNA, 618 nt, Artificial Sequence
  derived and/or modified CDS sequence (opt1) from Homo sapiens__NP_003801.1__HsALB(1-18)_HsTNFSF10(95-281)
augaagugggugaccuucaucagccugcucuuccuguucuccagcgccuacuccaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucggguga

SEQ ID NO: 78 - RNA, 714 nt, Artificial Sequence
  derived and/or modified CDS sequence (opt1) from Homo sapiens__NP_003801.1__HsALB(1-18)_ILZ_HsTNFSF10(95-281)
augaagugggugaccuucaucagccugcucuuccuguucuccagcgccuacucccgcaugaagcagaucgaggacaagaucgaggagauccugagcaagaucuaccacaucgagaacgagaucgcccggaucaagaagcucaucggcgagaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucggguga

SEQ ID NO: 79 - RNA, 1077 nt, Artificial Sequence
  derived and/or modified CDS sequence (opt1) from Rattus norvegicus__NP_036656.1__RnCebpa
auggagagcgccgacuucuacgaggccgagccccgcccgcccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccuga

SEQ ID NO: 80 - RNA, 1035 nt, Artificial Sequence
  derived and/or modified CDS sequence (opt1) from Rattus norvegicus__NP_036656.1__RnCebpa(15-344)
auguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccuga

SEQ ID NO: 81 - RNA, 1080 nt, Artificial Sequence
  derived and/or modified CDS sequence (opt1) from Mus musculus__NP_031704.2 __MmCebpa
auggagagcgccgacuucuacgagguggagccccgcccgcccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcguga

SEQ ID NO: 82 - RNA, 1038 nt, Artificial Sequence
  derived and/or modified CDS sequence (opt1) from Mus musculus__NP_031704.2 __MmCebpa(15-359)
auguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcguga

SEQ ID NO: 83 - RNA, 1077 nt, Artificial Sequence
  derived and/or modified CDS sequence (opt1) from Homo sapiens__NP_004355.2__HsCEBPA
auggagagcgccgacuucuacgaggccgagccccgcccgcccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccuga

SEQ ID NO: 84 - RNA, 1035 nt, Artificial Sequence
  derived and/or modified CDS sequence (opt1) from Homo sapiens__NP_004355.2__HsCEBPA(15-358)
auguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccuga

SEQ ID NO: 85 - RNA, 1425 nt, Artificial Sequence
  derived and/or modified CDS sequence (opt1) from Homo sapiens__NP_000448.3__HsHNF4A
augcgccugagcaagacccucguggacauggacauggccgacuacuccgccgcgcuggaccccgccuacaccacgcuggaguucgagaacguccaggugcucaccaugggcaacgacaccagcccguccgaggggaccaaccugaacgcccccaacagccugggcguguccgcccucugcgccaucugcggggaccgggcgacgggcaagcacuacggggccagcuccugcgacggcugcaagggcuucuuccgccggagcguccgcaagaaccacauguacuccugccgguucagccgccagugcgugguggacaaggacaagcggaaccagugccgcuacugccggcugaagaagugcuuccgcgccgggaugaagaaggaggccguccagaacgagcgggaccgcaucuccacccggcgcagcuccuacgaggacagcucccugcccagcaucaacgcgcuccugcaggccgaggugcugucccggcagaucaccagccccguguccggcaucaacggggacauccgcgccaagaagaucgccagcaucgccgacgucugcgagagcaugaaggagcagcuccuggugcugguggagugggcgaaguacaucccggccuucugcgagcucccccuggacgaccaggucgcccugcuccgggcccacgccggcgagcaccuccugcugggggcgaccaagcgcuccaugguguucaaggacgugcugcugcucggcaacgacuacaucgucccccggcacugccccgagcuggccgagaugagccgcguguccauccggauccuggacgagcucgugcugccguuccaggagcugcagaucgacgacaacgaguacgccuaccucaaggccaucaucuucuucgaccccgacgccaagggccugagcgaccccgggaagaucaagcgccugcgcucccagguccaggugagccucgaggacuacaucaacgaccggcaguacgacucccgcggccgguucggggagcugcugcuccugcugcccacgcuccagagcaucaccuggcagaugaucgagcagauccaguucaucaagcuguucggcauggcgaagaucgacaaccugcuccaggagaugcugcugggcggguccccgagcgacgcgccccacgcccaccacccccuccacccccaccugaugcaggagcacaugggcaccaacgugaucgucgccaacaccaugccgacgcaccuguccaacgggcagaugugcgaguggccccgcccccggggccaggccgccacccccgagaccccgcagcccagcccgcccgggggcuccggcagcgagcccuacaagcuccugcccggggccguggccaccaucgugaagccccuguccgccaucccccagccgacgaucaccaagcaggaggucaucuga

SEQ ID NO: 86 - RNA, 630 nt, Artificial Sequence
  derived and/or modified CDS sequence (opt1) from Homo sapiens__NP_061986.1__HsFGF21
auggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcuga

SEQ ID NO: 87 - RNA, 1356 nt, Artificial Sequence
  derived and/or modified CDS sequence (opt1) from Homo sapiens__NP_078852.3__HsOGFRL1
augggcaaccugcucgggggcgugagcuuccgcgagcccaccaccgucgaggacugcgacuccacguggcagaccgacagcgagccggagcccgaggagcccgggcccggcgggggcuccgagggcccggggcaggagagcgagcagcccgcccagccgcccgagcaggccggcgggcggcccggcgcgucccccgcccccgacgaggacgccgaggccgccggggcggagcagggcggcgacagcaccgaggccaccgccaagcccaagcgcuccuucuacgccgcgcgggaccuguacaaguaccgccaccaguacccgaacuucaaggacauccgguaccagaacgaccugagcaaccuccgcuucuacaagaacaagauccccuucaagcccgacgggguguacaucgaggaggugcuguccaaguggaagggcgacuacgagaagcuggagcacaaccacacguacauccaguggcuguucccccuccgggagcaggggcugaacuucuacgccaaggagcucaccaccuacgagaucgaggaguucaagaagaccaaggaggccauccgccgguuccugcuggccuacaagaugaugcucgaguucuucggcaucaagcugacggacaagaccggcaacgucgcccgcgcggugaacuggcaggagcgguuccagcaccugaacgagagccagcacaacuaccuccgcaucacccggauccugaagucccugggggagcucggcuacgagagcuucaaguccccgcuggugaaguucauccugcacgaggcccucgucgagaacaccauccccaacaucaagcagagcgcccuggaguacuucguguacacgauccgcgaccggcgcgagcggcgcaagcugcuccgguucgcccagaagcacuacacccccuccgagaacuucaucugggggcccccgcgcaaggagcagagcgagggcuccaaggcccagaagaugagcagcccccuggcguccagccacaacucccagaccagcaugcacaagaaggccaaggacuccaagaacagcuccagcgccgugcaccugaacuccaagaccgccgaggacaagaaggucgcccccaaggagcccguggaggagacggaccggccgagccccgagcccuccaacgaggcggccaagccccgcaacaccgagaaggacagcaacgccgagaacaugaacucccagccggagaagaccgugaccacgcccaccgagaagaaggagagcgucucccccgagaacaacgaggagggcgggaacgacaaccaggacaacgagaacccgggcaacaccaacugccacgacguggugcucguccaguga

SEQ ID NO: 88 - RNA, 558 nt, Artificial Sequence
  derived and/or modified CDS sequence (opt1) from Homo sapiens__NP_008842.1__HsRLN1
augccccgccuguuccucuuccaccuccuggaguucugccugcugcugaaccaguucagccgggccguggccgcgaaguggaaggacgacgucaucaagcucugcggccgcgagcuggugcgggcccagaucgccaucugcgggauguccaccuggagcaagcgcucccugagccaggaggacgccccgcagacgccccggcccguggccgagaucguccccuccuucaucaacaaggacaccgagaccaucaucaucaugcucgaguucaucgcgaaccugccgcccgagcugaaggccgcccucagcgagcgccagcccucccugcccgagcugcagcaguacgugccggcccucaaggacagcaaccuguccuucgaggaguucaagaagcugauccggaaccgccagagcgaggcggccgacuccaaccccagcgagcucaaguaccugggccuggacacccacucccagaagaagcggcgccccuacguggcccucuucgagaagugcugccugaucgggugcaccaagcggagccuggccaaguacugcuga

SEQ ID NO: 89 - RNA, 558 nt, Artificial Sequence
  derived and/or modified CDS sequence (opt1) from Homo sapiens__NP_604390.1__HsRLN2
augccccgccuguucuucuuccaccuccugggcgugugccugcuccugaaccaguucagccgggccgucgccgacuccuggauggaggaggugaucaagcugugcgggcgcgagcucgugcgggcgcagaucgccaucugcggcaugagcaccugguccaagcgcagccugucccaggaggacgccccgcagacgccccggcccgucgccgagaucgugcccagcuucaucaacaaggacaccgagaccaucaacaugauguccgaguucguggccaaccugccgcaggagcucaagcugacccugagcgagaugcagcccgcgcucccccagcugcagcagcacguccccgugcugaaggacuccagccuccuguucgaggaguucaagaagcugauccgcaaccggcaguccgaggccgccgacagcuccccgagcgagcucaaguaccuggggcuggacacccacucccgcaagaagcggcagcucuacagcgcccuggcgaacaagugcugccacgugggcugcacgaagcgcucccuggcccgguucugcuga

SEQ ID NO: 90 - RNA, 429 nt, Artificial Sequence
  derived and/or modified CDS sequence (opt1) from Homo sapiens__NP_543140.1__HsRLN3
auggcccgcuacaugcugcuccugcugcucgccguguggguccugaccggcgagcuguggcccggggcggaggcccgggccgccccguacggcgugcgccucugcgggcgggaguucauccgcgccgugaucuucacgugcggcgggagccgguggcgccgguccgacauccuggcgcacgaggccaugggcgacaccuuccccgacgccgacgccgacgaggacagccuggcgggcgagcucgacgaggccaugggguccagcgaguggcuggcccugaccaagagcccccaggccuucuaccgcggccggcccuccuggcaggggaccccgggcguccuccgcgggucccgggacgugcuggccggccugagcuccagcugcugcaaguggggcugcuccaagagcgagaucuccagccucugcuga

SEQ ID NO: 91 - RNA, 1410 nt, Artificial Sequence
  derived and/or modified CDS sequence (opt1) from Homo sapiens__NP_002412.1__HsMMP1
augcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacuga

SEQ ID NO: 92 - RNA, 1170 nt, Artificial Sequence
  derived and/or modified CDS sequence (opt1) from Homo sapiens__NP_002412.1__HsMMP1(1-19,100-469)
augcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacuga

SEQ ID NO: 93 - RNA, 3357 nt, Artificial Sequence
  derived and/or modified CDS sequence (opt1) from Clostridium histolyticum__BAA77453.1__ColG
augaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 94 - RNA, 3081 nt, Artificial Sequence
  derived and/or modified CDS sequence (opt1) from Clostridium histolyticum__BAA77453.1__HsALB(1-18)_ColG(111-1118)
augaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 95 - RNA, 3429 nt, Artificial Sequence
  derived and/or modified CDS sequence (opt1) from Clostridium histolyticum__BAA77453.1__HsALB(1-18)_ColG(1-110)_CS-F_ColG(111-1 118)
augaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 96 - RNA, 3105 nt, Artificial Sequence
  derived and/or modified CDS sequence (opt1) from Clostridium histolyticum__BAA34542.1__ColH
augaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcuga

SEQ ID NO: 97 - RNA, 3066 nt, Artificial Sequence
  derived and/or modified CDS sequence (opt1) from Clostridium histolyticum__BAA34542.1__ColH
augaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 98 - RNA, 3000 nt, Artificial Sequence
  derived and/or modified CDS sequence (opt1) from Clostridium histolyticum__BAA34542.1__HsALB(1-18)_ColH(41-1021)
augaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 99 - RNA, 3138 nt, Artificial Sequence
  derived and/or modified CDS sequence (opt1) from Clostridium histolyticum__BAA34542.1__HsALB(1-18)_ColH(1-40)_CS-F_ColH(41-102 1)
augaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 100 - RNA, 54 nt, Artificial Sequence
  derived and/or modified CDS sequence (opt2) from Homo sapiens__NP_000468.1__signal peptide-HsALB
augaagugggucaccuucaucucccuccucuuccucuucuccuccgccuacucc

SEQ ID NO: 101 - RNA, 96 nt, Artificial Sequence
  derived and/or modified CDS sequence (opt2) from Artificial__1GCM_A__isoleucinze zipper-ILZ
cgcaugaagcagaucgaggacaagaucgaggagauccucuccaagaucuaccacaucgagaacgagaucgcccgcaucaagaagcucaucggcgag

SEQ ID NO: 102 - RNA, 18 nt, Artificial Sequence
  derived and/or modified CDS sequence (opt2) from Artificial____cleavage site-Furin
cgccgccgccgcaagcgc

SEQ ID NO: 103 - RNA, 846 nt, Artificial Sequence
  derived and/or modified CDS sequence (opt2) from Homo sapiens__NP_003801.1__HsTNFSF10
auggccaugauggagguccagggcggccccucccucggccagaccugcguccucaucgucaucuucaccguccuccuccagucccucugcgucgccgucaccuacgucuacuucaccaacgagcucaagcagaugcaggacaaguacuccaaguccggcaucgccugcuuccucaaggaggacgacuccuacugggaccccaacgacgaggaguccaugaacucccccugcuggcaggucaaguggcagcuccgccagcucguccgcaagaugauccuccgcaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcuga

SEQ ID NO: 104 - RNA, 564 nt, Artificial Sequence
  derived and/or modified CDS sequence (opt2) from Homo sapiens__NP_003801.1__HsTNFSF10(95-281)
accuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcuga

SEQ ID NO: 105 - RNA, 618 nt, Artificial Sequence
  derived and/or modified CDS sequence (opt2) from Homo sapiens__NP_003801.1__HsALB(1-18)_HsTNFSF10(95-281)
augaagugggucaccuucaucucccuccucuuccucuucuccuccgccuacuccaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcuga

SEQ ID NO: 106 - RNA, 714 nt, Artificial Sequence
  derived and/or modified CDS sequence (opt2) from Homo sapiens__NP_003801.1__HsALB(1-18)_ILZ_HsTNFSF10(95-281)
augaagugggucaccuucaucucccuccucuuccucuucuccuccgccuacucccgcaugaagcagaucgaggacaagaucgaggagauccucuccaagaucuaccacaucgagaacgagaucgcccgcaucaagaagcucaucggcgagaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcuga

SEQ ID NO: 107 - RNA, 1077 nt, Artificial Sequence
  derived and/or modified CDS sequence (opt2) from Rattus norvegicus__NP_036656.1__RnCebpa
auggaguccgccgacuucuacgaggccgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccuga

SEQ ID NO: 108 - RNA, 1035 nt, Artificial Sequence
  derived and/or modified CDS sequence (opt2) from Rattus norvegicus__NP_036656.1__RnCebpa(15-344)
auguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccuga

SEQ ID NO: 109 - RNA, 1080 nt, Artificial Sequence
  derived and/or modified CDS sequence (opt2) from Mus musculus__NP_031704.2 __MmCebpa
auggaguccgccgacuucuacgaggucgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccuga

SEQ ID NO: 110 - RNA, 1038 nt, Artificial Sequence
  derived and/or modified CDS sequence (opt2) from Mus musculus__NP_031704.2 __MmCebpa(15-359)
auguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccuga

SEQ ID NO: 111 - RNA, 1077 nt, Artificial Sequence
  derived and/or modified CDS sequence (opt2) from Homo sapiens__NP_004355.2__HsCEBPA
auggaguccgccgacuucuacgaggccgagccccgcccccccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccuga

SEQ ID NO: 112 - RNA, 1035 nt, Artificial Sequence
  derived and/or modified CDS sequence (opt2) from Homo sapiens__NP_004355.2__HsCEBPA(15-358)
auguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccuga

SEQ ID NO: 113 - RNA, 1425 nt, Artificial Sequence
  derived and/or modified CDS sequence (opt2) from Homo sapiens__NP_000448.3__HsHNF4A
augcgccucuccaagacccucgucgacauggacauggccgacuacuccgccgcccucgaccccgccuacaccacccucgaguucgagaacguccagguccucaccaugggcaacgacaccucccccuccgagggcaccaaccucaacgcccccaacucccucggcgucuccgcccucugcgccaucugcggcgaccgcgccaccggcaagcacuacggcgccuccuccugcgacggcugcaagggcuucuuccgccgcuccguccgcaagaaccacauguacuccugccgcuucucccgccagugcgucgucgacaaggacaagcgcaaccagugccgcuacugccgccucaagaagugcuuccgcgccggcaugaagaaggaggccguccagaacgagcgcgaccgcaucuccacccgccgcuccuccuacgaggacuccucccuccccuccaucaacgcccuccuccaggccgagguccucucccgccagaucaccucccccgucuccggcaucaacggcgacauccgcgccaagaagaucgccuccaucgccgacgucugcgaguccaugaaggagcagcuccucguccucgucgagugggccaaguacauccccgccuucugcgagcucccccucgacgaccaggucgcccuccuccgcgcccacgccggcgagcaccuccuccucggcgccaccaagcgcuccauggucuucaaggacguccuccuccucggcaacgacuacaucgucccccgccacugccccgagcucgccgagaugucccgcgucuccauccgcauccucgacgagcucguccuccccuuccaggagcuccagaucgacgacaacgaguacgccuaccucaaggccaucaucuucuucgaccccgacgccaagggccucuccgaccccggcaagaucaagcgccuccgcucccagguccaggucucccucgaggacuacaucaacgaccgccaguacgacucccgcggccgcuucggcgagcuccuccuccuccuccccacccuccaguccaucaccuggcagaugaucgagcagauccaguucaucaagcucuucggcauggccaagaucgacaaccuccuccaggagaugcuccucggcggcucccccuccgacgccccccacgcccaccacccccuccacccccaccucaugcaggagcacaugggcaccaacgucaucgucgccaacaccaugcccacccaccucuccaacggccagaugugcgaguggccccgcccccgcggccaggccgccacccccgagaccccccagcccuccccccccggcggcuccggcuccgagcccuacaagcuccuccccggcgccgucgccaccaucgucaagccccucuccgccaucccccagcccaccaucaccaagcaggaggucaucuga

SEQ ID NO: 114 - RNA, 630 nt, Artificial Sequence
  derived and/or modified CDS sequence (opt2) from Homo sapiens__NP_061986.1__HsFGF21
auggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccuga

SEQ ID NO: 115 - RNA, 1356 nt, Artificial Sequence
  derived and/or modified CDS sequence (opt2) from Homo sapiens__NP_078852.3__HsOGFRL1
augggcaaccuccucggcggcgucuccuuccgcgagcccaccaccgucgaggacugcgacuccaccuggcagaccgacuccgagcccgagcccgaggagcccggccccggcggcggcuccgagggccccggccaggaguccgagcagcccgcccagccccccgagcaggccggcggccgccccggcgccucccccgcccccgacgaggacgccgaggccgccggcgccgagcagggcggcgacuccaccgaggccaccgccaagcccaagcgcuccuucuacgccgcccgcgaccucuacaaguaccgccaccaguaccccaacuucaaggacauccgcuaccagaacgaccucuccaaccuccgcuucuacaagaacaagauccccuucaagcccgacggcgucuacaucgaggagguccucuccaaguggaagggcgacuacgagaagcucgagcacaaccacaccuacauccaguggcucuucccccuccgcgagcagggccucaacuucuacgccaaggagcucaccaccuacgagaucgaggaguucaagaagaccaaggaggccauccgccgcuuccuccucgccuacaagaugaugcucgaguucuucggcaucaagcucaccgacaagaccggcaacgucgcccgcgccgucaacuggcaggagcgcuuccagcaccucaacgagucccagcacaacuaccuccgcaucacccgcauccucaagucccucggcgagcucggcuacgaguccuucaaguccccccucgucaaguucauccuccacgaggcccucgucgagaacaccauccccaacaucaagcaguccgcccucgaguacuucgucuacaccauccgcgaccgccgcgagcgccgcaagcuccuccgcuucgcccagaagcacuacacccccuccgagaacuucaucuggggccccccccgcaaggagcaguccgagggcuccaaggcccagaagauguccuccccccucgccuccucccacaacucccagaccuccaugcacaagaaggccaaggacuccaagaacuccuccuccgccguccaccucaacuccaagaccgccgaggacaagaaggucgcccccaaggagcccgucgaggagaccgaccgccccucccccgagcccuccaacgaggccgccaagccccgcaacaccgagaaggacuccaacgccgagaacaugaacucccagcccgagaagaccgucaccacccccaccgagaagaaggaguccgucucccccgagaacaacgaggagggcggcaacgacaaccaggacaacgagaaccccggcaacaccaacugccacgacgucguccucguccaguga

SEQ ID NO: 116 - RNA, 558 nt, Artificial Sequence
  derived and/or modified CDS sequence (opt2) from Homo sapiens__NP_008842.1__HsRLN1
augccccgccucuuccucuuccaccuccucgaguucugccuccuccucaaccaguucucccgcgccgucgccgccaaguggaaggacgacgucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaucaucaugcucgaguucaucgccaaccucccccccgagcucaaggccgcccucuccgagcgccagcccucccuccccgagcuccagcaguacguccccgcccucaaggacuccaaccucuccuucgaggaguucaagaagcucauccgcaaccgccaguccgaggccgccgacuccaaccccuccgagcucaaguaccucggccucgacacccacucccagaagaagcgccgccccuacgucgcccucuucgagaagugcugccucaucggcugcaccaagcgcucccucgccaaguacugcuga

SEQ ID NO: 117 - RNA, 558 nt, Artificial Sequence
  derived and/or modified CDS sequence (opt2) from Homo sapiens__NP_604390.1__HsRLN2
augccccgccucuucuucuuccaccuccucggcgucugccuccuccucaaccaguucucccgcgccgucgccgacuccuggauggaggaggucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugcuga

SEQ ID NO: 118 - RNA, 429 nt, Artificial Sequence
  derived and/or modified CDS sequence (opt2) from Homo sapiens__NP_543140.1__HsRLN3
auggcccgcuacaugcuccuccuccuccucgccgucuggguccucaccggcgagcucuggcccggcgccgaggcccgcgccgcccccuacggcguccgccucugcggccgcgaguucauccgcgccgucaucuucaccugcggcggcucccgcuggcgccgcuccgacauccucgcccacgaggccaugggcgacaccuuccccgacgccgacgccgacgaggacucccucgccggcgagcucgacgaggccaugggcuccuccgaguggcucgcccucaccaaguccccccaggccuucuaccgcggccgccccuccuggcagggcacccccggcguccuccgcggcucccgcgacguccucgccggccucuccuccuccugcugcaaguggggcugcuccaaguccgagaucuccucccucugcuga

SEQ ID NO: 119 - RNA, 1410 nt, Artificial Sequence
  derived and/or modified CDS sequence (opt2) from Homo sapiens__NP_002412.1__HsMMP1
augcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacuga

SEQ ID NO: 120 - RNA, 1170 nt, Artificial Sequence
  derived and/or modified CDS sequence (opt2) from Homo sapiens__NP_002412.1__HsMMP1(1-19,100-469)
augcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacuga

SEQ ID NO: 121 - RNA, 3357 nt, Artificial Sequence
  derived and/or modified CDS sequence (opt2) from Clostridium histolyticum__BAA77453.1__ColG
augaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 122 - RNA, 3081 nt, Artificial Sequence
  derived and/or modified CDS sequence (opt2) from Clostridium histolyticum__BAA77453.1__HsALB(1-18)_ColG(111-1118)
augaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 123 - RNA, 3429 nt, Artificial Sequence
  derived and/or modified CDS sequence (opt2) from Clostridium histolyticum__BAA77453.1__HsALB(1-18)_ColG(1-110)_CS-F_ColG(111-1 118)
augaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 124 - RNA, 3105 nt, Artificial Sequence
  derived and/or modified CDS sequence (opt2) from Clostridium histolyticum__BAA34542.1__ColH
augaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 125 - RNA, 3066 nt, Artificial Sequence
  derived and/or modified CDS sequence (opt2) from Clostridium histolyticum__BAA34542.1__ColH
augaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 126 - RNA, 3000 nt, Artificial Sequence
  derived and/or modified CDS sequence (opt2) from Clostridium histolyticum__BAA34542.1__HsALB(1-18)_ColH(41-1021)
augaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 127 - RNA, 3138 nt, Artificial Sequence
  derived and/or modified CDS sequence (opt2) from Clostridium histolyticum__BAA34542.1__HsALB(1-18)_ColH(1-40)_CS-F_ColH(41-102 1)
augaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 128 - RNA, 54 nt, Artificial Sequence
  derived and/or modified CDS sequence (opt3) from Homo sapiens__NP_000468.1__signal peptide-HsALB
augaagugggugaccuucaucagccugcucuuucuuuucuccucugccuacuca

SEQ ID NO: 129 - RNA, 96 nt, Artificial Sequence
  derived and/or modified CDS sequence (opt3) from Artificial__1GCM_A__isoleucinze zipper-ILZ
agaaugaagcagaucgaggacaaaauugaagagauacugagcaagaucuaccacauugaaaacgagaucgccaggauuaaaaagcucaucggcgaa

SEQ ID NO: 130 - RNA, 18 nt, Artificial Sequence
  derived and/or modified CDS sequence (opt3) from Artificial____cleavage site-Furin
agaaggcggcgcaagcga

SEQ ID NO: 131 - RNA, 846 nt, Artificial Sequence
  derived and/or modified CDS sequence (opt3) from Homo sapiens__NP_003801.1__HsTNFSF10
auggccaugauggaggugcagggcgggcccagccugggacaaaccugcguccucaucguuauuuucacagugcuucugcaguccuuguguguagcugugacuuacgucuauuuuacgaacgaauuaaagcagaugcaggacaaauacucuaagucagguauagcaugcuuccugaaagaggaugacaguuauugggauccuaaugacgaagagagcaugaacuccccauguuggcaagugaaguggcagcuaagacagcucguuaggaaaaugauccugcggaccucugaagagacaauuucgacugugcaggagaagcaacagaauaucucaccgcuuguccgcgaacgaggcccccagcguguggccgcgcacauuaccgggacaagaggaaggagcaacacccugaguuccccuaauucuaagaacgagaaggcuuugggccggaaaaucaauagcugggaauccucacgcaguggucauagcuuucucucuaaccugcaccugagaaauggggagcucguaauacaugagaaaggauucuacuauaucuacucccagacuuauuuuagguuccaagaagagauuaaggaaaacaccaaaaaugauaagcagaugguucaguacaucuacaaguauacaucauacccagaccccauuuuacugaugaaaagcgcccggaacaguugcuggucuaaggaugcagaguauggccuuuacuccaucuaucaaggcgggauauuugaauugaaagagaaugaccgcauuuucgugagcgucacgaacgagcaccugaucgauauggaccaugaagccucguuuuucggagcuuuucuaguggguuga

SEQ ID NO: 132 - RNA, 564 nt, Artificial Sequence
  derived and/or modified CDS sequence (opt3) from Homo sapiens__NP_003801.1__HsTNFSF10(95-281)
accagcgaagaaacaaucuccacugugcaggagaagcaacagaacauuucuccccuggucagagaaaggggcccucagcggguugccgcucacauaacggggacccgcggacgaucaaauacacucaguagcccaaacuccaaaaaugagaaggcacuuggucguaaaaucaacucuugggaaucgucaagaagcggccauaguuuccuguccaauuugcacuuaaggaacggggagcuggugauucaugagaagggauuuuacuauaucuacucucagacuuauuuccgguuucaagaagagauuaaagaaaauaccaagaacgacaagcagaugguacaguacaucuauaaauacacaagcuauccggaucccauacuacucaugaaguccgcccgcaauucaugcuggaguaaagacgcggaguacggccuguacagcaucuaucagggugggauuuucgagcuuaaggaaaacgauagaaucuuugugucugucaccaaugagcaccugauugacauggaucaugaggcuuccuucuuuggagccuucuuggugggcuga

SEQ ID NO: 133 - RNA, 618 nt, Artificial Sequence
  derived and/or modified CDS sequence (opt3) from Homo sapiens__NP_003801.1__HsALB(1-18)_HsTNFSF10(95-281)
augaagugggugaccuucaucagccugcucuuucuuuucuccucugccuacucaacaagugaggaaacuauuagcacgguccaggagaaacaacagaacauaucuccccugguuagagaaaggggcccucagcggguggcugcacacaucaccgggacacgcggacgaucuaauacuuugucgucaccaaacagcaagaaugagaaagccuuaggucguaagauuaacaguugggaauccucuagaagcggccauuccuuucugucaaaucuacaccucaggaacggggagcugguaauccaugagaaaggauucuauuacauuuauagucagaccuacuuucgguuccaagaagagaucaaggaaaauacaaagaacgacaaacagauggugcaguauauauacaaguauaccagcuacccggaucccauccuucugaugaaaucugcgcgcaauuccugcuggucaaaggacgcugaguacggcuuguauagcauuuaccagggugggaucuuugagcucaaagaaaacgauagaauuuucgucagugugacuaaugagcaccugaucgacauggaucaugaagccuccuuuuucggagcauuucugguuggcuga

SEQ ID NO: 134 - RNA, 714 nt, Artificial Sequence
  derived and/or modified CDS sequence (opt3) from Homo sapiens__NP_003801.1__HsALB(1-18)_ILZ_HsTNFSF10(95-281)
augaagugggugaccuucaucagccugcucuuucuuuucuccucugccuacucaagaaugaaacagauugaggacaagauagaagagauccugaguaaaauuuaucacaucgaaaacgagauugcuaggaucaagaaauugauaggcgaaacaagcgaggagacuaucuccacgguccaagaaaagcagcagaauauuucucccuuaguucgggagcgcgggccucagcgaguggcagcccauaucaccggaacacgugguagaucgaacacucugucaagcccaaauaguaagaacgaaaaagcgcuaggcaggaagauuaauuccugggagucuagccgguccgggcacucauuucucaguaaccugcaucuucgcaauggagagcugguaauccacgaaaaaggcuucuacuauauauacagccaaaccuauuuuagauuccaggaggaaauuaaggagaacaccaaaaaugauaagcagauggugcaguacaucuauaaguacacaucuuacccggaccccauuuugcucaugaaauccgcuaggaacucaugcuggagcaaggaugccgaauauggucuguacaguaucuaucaagggggaaucuuugagcugaaagagaaugaccggauuuucgucucugugacuaacgaacaucucauagauauggaccacgaggcauccuuuuucggcgccuuuuuaguuggcuga

SEQ ID NO: 135 - RNA, 1077 nt, Artificial Sequence
  derived and/or modified CDS sequence (opt3) from Rattus norvegicus__NP_036656.1__RnCebpa
auggagagcgccgacuucuacgaagcugagcccagaccuccaauguccucucaucugcagucaccgccccacgcaccuaguaacgccgcguuuggcuucccaaggggagcugggcccgccccuccacccgcaccuccagccgcuccggaaccccucgguggcaucugcgagcacgaaaccagcauugauauauccgcauauaucgacccugccgcuuuuaaugaugaguuccuugccgaccuguuucaacauucucggcagcaggagaaggcgaaagcagccgcugggccagccggaggcgguggggauuucgacuaccccggagcuccugcaggcccaggcggggccgugaugucggcgggagcccacggucccccgccuggcuaugggugugcagcugccggauacuuggauggccgcuuagaaccccuguaugagcgagucggugcuccagcccuacguccucucguuauuaagcaggaacccagagaggaggacgaagcaaaacaacuggcccuugcugggcuguuuccauaccagcccccuccaccgcccccuccaccccauccucacgcgucaccagcacacuuggccgcuccccaucuccaguuccagaucgcccacugcggacaaacaacuaugcaucugcagccgggccacccuacgccacccccuacccccgugccaagcccucaccccgcaccagccaugggcgcugccgggcugccgggaccugguggcagucucaagggguuagcaggaccccauccagaucugaggacaggcggugggggcggaggcggggcgggagcugguaaagccaagaaguccguagacaaaaacucuaaugaguaucgggugcgcagagaaaggaacaauauugcaguccgcaagagccgggauaaagccaagcagcgaaacguggagacucagcaaaaaguucuugaauugaccuccgacaaugauagacugaggaagcggguggagcagcuaucacgugagcucgacacacugcgcggcaucuuuagacagcuucccgaaaguagccuggucaaggcuauggggaacugugccuga

SEQ ID NO: 136 - RNA, 1035 nt, Artificial Sequence
  derived and/or modified CDS sequence (opt3) from Rattus norvegicus__NP_036656.1__RnCebpa(15-344)
augagcucccaucugcagucucccccucacgccccaucaaacgcugcauucggcuuuccgagaggggccggacccgcgccuccacccgcuccuccagccgcacccgagccucucgguggcaucugcgaacacgagaccaguauugacauaagcgccuacaucgauccagcugcauucaaugacgaauuucuugccgaucuguuccaacauuccaggcagcaggagaaggcuaaagccgcggcagggccggccggaggcgguggggacuuugauuaucccggagcuccugccggcccaggcggggcagugaugucugcuggagcccacggucccccuccaggcuacgggugugcggccgcaggauauuuggacggccgguuagaaccccuguacgagcgcgucggugcuccggcccuacgaccucucguuauuaagcaggagccccgugaagaggaugaagcuaaacaacuggcccuugcagggcuguucccauaucagccucccccacccccuccaccgccccauccucacgccucgccagcucacuuggcggcaccccaucuccaguuucagaucgcccacugcggacaaacaacuaugcaucugcagccuggccacccaacgcccccgccuaccccagugcccucaccucaccccgcuccagccaugggcgcagccgggcugccuggacccgguggcagccucaagggguuagcuggaccacauccggaccugagaacaggcggugggggcggaggcggggccggagcagguaaagcgaagaagaguguagauaaaaacuccaaugaguacagggugcggcgcgagagaaacaauauugcugucaggaagucucgggacaaagccaagcagcgcaacguggaaacucagcaaaaaguucuugaguugaccagcgauaaugaccgacugagaaagaggguggaacagcuaucccgggagcucgauacacugcguggcaucuuccgccagcuuccugaaucaagucuggucaaggcaauggggaacugugccuga

SEQ ID NO: 137 - RNA, 1080 nt, Artificial Sequence
  derived and/or modified CDS sequence (opt3) from Mus musculus__NP_031704.2 __MmCebpa
auggaaagcgccgacuucuacgagguggaacccagaccuccuaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaa

SEQ ID NO: 138 - RNA, 1038 nt, Artificial Sequence
  derived and/or modified CDS sequence (opt3) from Mus musculus__NP_031704.2 __MmCebpa(15-359)
augagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaa

SEQ ID NO: 139 - RNA, 1077 nt, Artificial Sequence
  derived and/or modified CDS sequence (opt3) from Homo sapiens__NP_004355.2__HsCEBPA
auggagagcgccgacuucuacgaagcugagcccagaccuccaauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccuga

SEQ ID NO: 140 - RNA, 1035 nt, Artificial Sequence
  derived and/or modified CDS sequence (opt3) from Homo sapiens__NP_004355.2__HsCEBPA(15-358)
auguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccuga

SEQ ID NO: 141 - RNA, 1425 nt, Artificial Sequence
  derived and/or modified CDS sequence (opt3) from Homo sapiens__NP_000448.3__HsHNF4A
augagacugagcaagacccucguggacauggauauggccgacuacuccgcugcacuugaucccgccuauacaacucuggaguucgaaaacguccagguuuugacgaugggcaaugacaccucuccuucagaggggacaaacuuaaaugcgccaaacagucugggagugagcgcucuaugcgccaucuguggugauagggcaacuggcaaacacuacggggccuccucuugcgacggauguaagggcuuuuuccggcgcucgguacguaaaaaucauauguauucaugccgauuuagcagacaauguguggucgauaaggacaaaaggaaccagugccgguacugucgccucaagaagugcuucagagcugguaugaaaaaggaagcagugcagaaugagagggaucggauuaguacccgccgauccucuuaugaagacagcucccugccgucaauaaacgcccuucugcaggcugagguuuugaguagacaaaucacaagccccgugucugggauuaauggagauaucagggccaaaaagauugcguccaucgcagacgucugugagucaaugaaagaacagcuccuggugcugguagagugggccaaguacauaccugcuuuuugcgaacucccauuagaugaccagguugcccugcuucgggcacacgcuggcgagcauuugcugcuaggcgccaccaagcguagcaugguguucaaagacguccuccugcuugggaacgauuauaucgugccccgccacuguccugagcuggcggaaaugaguagagugucuauuaggaucuuggacgagcucguccugccauuucaggaauuacaaauugaugacaaugaguacgccuaccugaaggcaaucauauucuuugaucccgacgcuaaaggacucuccgauccugguaagauuaaacggcuucgaagccagguucaggugucgcuggaagacuauaucaacgaucgccaguacgacucuagaggcagguucggggaguugcuacugcuccugccaacucuucaauccauuacauggcagaugaucgagcagauccaauuuauuaagcuguucggaauggccaaaauagauaauuugcuccaggaaaugcuguuaggcgguucaccgagugacgcuccccaugcccaccacccucugcauccacaccuaaugcaggagcauauggggaccaacguaaucguggcaaauacgaugcccacucaccucagcaacggacagaugugcgaauggccucggccacgcggccaagccgcuacccccgagacaccgcagccuucucccccaggcggguccggaagcgaaccuuauaagcugcuucccggugcggucgcaacuauugugaagccauugucagccaucccccagccuaccauaacaaaacaggagguuauuuga

SEQ ID NO: 142 - RNA, 630 nt, Artificial Sequence
  derived and/or modified CDS sequence (opt3) from Homo sapiens__NP_061986.1__HsFGF21
auggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcuga

SEQ ID NO: 143 - RNA, 1356 nt, Artificial Sequence
  derived and/or modified CDS sequence (opt3) from Homo sapiens__NP_078852.3__HsOGFRL1
augggcaaccugcucgggggagugagcuucagagagcccaccacagucgaagacugcgauuccacuuggcagacggacucugagccugaaccagaggaaccgggucccggcgggggaucagagggcccuggucaagagagugaacagccagcccagcccccugagcaggcugggggaaggccaggcgcaagccccgccccugaugaagacgcggaggcugccggcgcagagcaagggggagauuccaccgaagccacagcuaagccaaaacggucuuuuuacgcagcccgcgaccuuuauaaguaccgacaccaguauccgaauuucaaagauauccguuaccagaacgaccugucgaauuugagauuuuauaagaacaaaauucccuucaagccugaugguguuuacauagaggaaguguuaucaaaguggaaaggcgacuaugagaagcuggaacauaaucacacuuacauccaguggcuauuuccacucagggagcaagggcugaacuucuacgcuaaagagcuuaccacauaugaaauugaggaauuuaagaaaaccaaggaggccauccggcgcuuccuguuggcguacaagaugaugcucgaauuuuucggaauuaaacugacugauaagacaggcaauguagcaagagccgugaacuggcaggagagguuucagcaucugaaugagagccagcacaacuaucuccggaucacccgcauauuaaaaagucugggugaacuuggguacgaguccuucaagucucccuuggucaaauuuauccugcaugaagcucuaguggagaauacgauuccuaacaucaagcaaagcgcccucgaauauuucguuuacacuauucgagacagaagggagcggcguaaacugcuucgcuucgcacagaagcacuauaccccauccgagaauuuuaucuggggacccccgagaaaggaacagucagagggcaguaaagcucaaaagaugagcucuccucuggccuccucacacaacagccagacaaguaugcauaaaaaggcgaaagauucuaaaaauuccagcucggccgugcacuugaacucuaagacugcagaagacaagaaggucgcucccaaagagccaguggaggaaaccgacaggccuucccccgagccaucaaacgaagccgcuaagccccggaauacagagaaagauaguaacgccgaaaauaugaacagccagccugagaagaccguaacgacuccaacagagaagaaagaauccguuucuccggagaauaacgaagagggcgggaaugacaaccaggauaaugaaaaccccggaaauaccaacugucaugacgugguccucgugcaauga

SEQ ID NO: 144 - RNA, 558 nt, Artificial Sequence
  derived and/or modified CDS sequence (opt3) from Homo sapiens__NP_008842.1__HsRLN1
augcccagacuguuccucuuucaccuucuggaguucugcuuguuacugaaccaguuuagcagggccguggcugcaaaguggaaagacgaugucaucaagcuauguggccgggaacucguucgcgcccaaauugcgauaugcgggauguccaccuggucuaaacgaucacugagucaggaggacgcuccucagacaccacguccgguggccgaaaucguacccagcuucauuaauaaggauacugagacgaucauuaucaugcuugaauuuauagcaaaccugccuccagaguugaaagccgcucucuccgagagacagcccucucugccugaacugcaacaguacgugccagcacucaaggacucgaauuuaucauucgaggaauuuaagaaacugaucaggaaccggcagagcgaggccgcugauaguaaucccuccgagcuuaaguauuugggacuggacacccauucucagaaaaagcgcagaccuuacgucgcccuauucgaaaaauguugccucauugguuguacaaagaggagccuggcgaaguauugcuga

SEQ ID NO: 145 - RNA, 558 nt, Artificial Sequence
  derived and/or modified CDS sequence (opt3) from Homo sapiens__NP_604390.1__HsRLN2
augcccagacuguucuuuuuccaccuccuuggcgugugccuguuguuaaaccaguuuagcagggccgucgcugacuccuggauggaggaaguuaucaagcugugugggcgggagcuagugcgcgcacaaauugccauaugcggaaugucuaccuggucaaaacgaagucucagccaggaagaugcgccucagacaccacguccgguagcugagaucgugcccuccuucauuaauaaggacacugaaacgaucaacaugaugucugaguuugucgccaaucugccucaggagcuuaaacugaccuugucggaaaugcaaccagcacucccccagcugcagcagcaugugccuguucugaaggauucaagccucuuauucgaggaauuuaaaaagcugauuagaaacaggcaaagugaggccgcugacuccucuccaagcgagcuuaaguacuugggucuggauacacacucccggaaaaagcgccagcuauauucagcacucgccaauaaauguugccaugugggcuguacuaagagaagucuggcuagguucugcuga

SEQ ID NO: 146 - RNA, 429 nt, Artificial Sequence
  derived and/or modified CDS sequence (opt3) from Homo sapiens__NP_543140.1__HsRLN3
auggccagauacaugcugcuccuucuguuggcugugugggucuuaaccggcgagcuguggcccggggcagaagccagggcggcuccuuauggaguucggcuaugcggucgcgaguucauccgagccgugauuuuuacauguggcgggagccguuggagaagguccgacauacucgcacacgaagccaugggagauacuuucccagacgcugaugcagacgaggauucucuggccggcgaacuugacgaggcuauggguucaagugaguggcuggccuugaccaagagcccgcaggcguuuuaccgggggcgccccuccuggcaaggaacgccuggcguacucagaggcucuagggaugugcuggcagggcugucgucaagcugcuguaaauggggaugcaguaaguccgaaaucucuagccucuguuga

SEQ ID NO: 147 - RNA, 1410 nt, Artificial Sequence
  derived and/or modified CDS sequence (opt3) from Homo sapiens__NP_002412.1__HsMMP1
augcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacuga

SEQ ID NO: 148 - RNA, 1170 nt, Artificial Sequence
  derived and/or modified CDS sequence (opt3) from Homo sapiens__NP_002412.1__HsMMP1(1-19,100-469)
augcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauuga

SEQ ID NO: 149 - RNA, 3357 nt, Artificial Sequence
  derived and/or modified CDS sequence (opt3) from Clostridium histolyticum__BAA77453.1__ColG
augaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaauga

SEQ ID NO: 150 - RNA, 3081 nt, Artificial Sequence
  derived and/or modified CDS sequence (opt3) from Clostridium histolyticum__BAA77453.1__HsALB(1-18)_ColG(111-1118)
augaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaaguga

SEQ ID NO: 151 - RNA, 3429 nt, Artificial Sequence
  derived and/or modified CDS sequence (opt3) from Clostridium histolyticum__BAA77453.1__HsALB(1-18)_ColG(1-110)_CS-F_ColG(111-1 118)
augaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaaguga

SEQ ID NO: 152 - RNA, 3105 nt, Artificial Sequence
  derived and/or modified CDS sequence (opt3) from Clostridium histolyticum__BAA34542.1__ColH
augaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgauga

SEQ ID NO: 153 - RNA, 3066 nt, Artificial Sequence
  derived and/or modified CDS sequence (opt3) from Clostridium histolyticum__BAA34542.1__ColH
augaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccgguga

SEQ ID NO: 154 - RNA, 3000 nt, Artificial Sequence
  derived and/or modified CDS sequence (opt3) from Clostridium histolyticum__BAA34542.1__HsALB(1-18)_ColH(41-1021)
augaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggagguga

SEQ ID NO: 155 - RNA, 3138 nt, Artificial Sequence
  derived and/or modified CDS sequence (opt3) from Clostridium histolyticum__BAA34542.1__HsALB(1-18)_ColH(1-40)_CS-F_ColH(41-102 1)
augaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccgguga

SEQ ID NO: 156 - RNA, 54 nt, Artificial Sequence
  derived and/or modified CDS sequence (opt4) from Homo sapiens__NP_000468.1__signal peptide-HsALB
augaagugggugaccuucaucagccugcuguuccuguucagcagcgccuacagc

SEQ ID NO: 157 - RNA, 96 nt, Artificial Sequence
  derived and/or modified CDS sequence (opt4) from Artificial__1GCM_A__isoleucinze zipper-ILZ
agaaugaagcagaucgaggacaagaucgaggagauccugagcaagaucuaccacaucgagaacgagaucgccagaaucaagaagcugaucggcgag

SEQ ID NO: 158 - RNA, 18 nt, Artificial Sequence
  derived and/or modified CDS sequence (opt4) from Artificial____cleavage site-Furin
agaagaagaagaaagaga

SEQ ID NO: 159 - RNA, 846 nt, Artificial Sequence
  derived and/or modified CDS sequence (opt4) from Homo sapiens__NP_003801.1__HsTNFSF10
auggccaugauggaggugcagggcggccccagccugggccagaccugcgugcugaucgugaucuucaccgugcugcugcagagccugugcguggccgugaccuacguguacuucaccaacgagcugaagcagaugcaggacaaguacagcaagagcggcaucgccugcuuccugaaggaggacgacagcuacugggaccccaacgacgaggagagcaugaacagccccugcuggcaggugaaguggcagcugagacagcuggugagaaagaugauccugagaaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcuga

SEQ ID NO: 160 - RNA, 564 nt, Artificial Sequence
  derived and/or modified CDS sequence (opt4) from Homo sapiens__NP_003801.1__HsTNFSF10(95-281)
accagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcuga

SEQ ID NO: 161 - RNA, 618 nt, Artificial Sequence
  derived and/or modified CDS sequence (opt4) from Homo sapiens__NP_003801.1__HsALB(1-18)_HsTNFSF10(95-281)
augaagugggugaccuucaucagccugcuguuccuguucagcagcgccuacagcaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcuga

SEQ ID NO: 162 - RNA, 714 nt, Artificial Sequence
  derived and/or modified CDS sequence (opt4) from Homo sapiens__NP_003801.1__HsALB(1-18)_ILZ_HsTNFSF10(95-281)
augaagugggugaccuucaucagccugcuguuccuguucagcagcgccuacagcagaaugaagcagaucgaggacaagaucgaggagauccugagcaagaucuaccacaucgagaacgagaucgccagaaucaagaagcugaucggcgagaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcuga

SEQ ID NO: 163 - RNA, 1077 nt, Artificial Sequence
  derived and/or modified CDS sequence (opt4) from Rattus norvegicus__NP_036656.1__RnCebpa
auggagagcgccgacuucuacgaggccgagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccuga

SEQ ID NO: 164 - RNA, 1035 nt, Artificial Sequence
  derived and/or modified CDS sequence (opt4) from Rattus norvegicus__NP_036656.1__RnCebpa(15-344)
augagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccuga

SEQ ID NO: 165 - RNA, 1080 nt, Artificial Sequence
  derived and/or modified CDS sequence (opt4) from Mus musculus__NP_031704.2 __MmCebpa
auggagagcgccgacuucuacgagguggagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccuga

SEQ ID NO: 166 - RNA, 1038 nt, Artificial Sequence
  derived and/or modified CDS sequence (opt4) from Mus musculus__NP_031704.2 __MmCebpa(15-359)
augagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccuga

SEQ ID NO: 167 - RNA, 1077 nt, Artificial Sequence
  derived and/or modified CDS sequence (opt4) from Homo sapiens__NP_004355.2__HsCEBPA
auggagagcgccgacuucuacgaggccgagcccagaccccccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccuga

SEQ ID NO: 168 - RNA, 1035 nt, Artificial Sequence
  derived and/or modified CDS sequence (opt4) from Homo sapiens__NP_004355.2__HsCEBPA(15-358)
augagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccuga

SEQ ID NO: 169 - RNA, 1425 nt, Artificial Sequence
  derived and/or modified CDS sequence (opt4) from Homo sapiens__NP_000448.3__HsHNF4A
augagacugagcaagacccugguggacauggacauggccgacuacagcgccgcccuggaccccgccuacaccacccuggaguucgagaacgugcaggugcugaccaugggcaacgacaccagccccagcgagggcaccaaccugaacgcccccaacagccugggcgugagcgcccugugcgccaucugcggcgacagagccaccggcaagcacuacggcgccagcagcugcgacggcugcaagggcuucuucagaagaagcgugagaaagaaccacauguacagcugcagauucagcagacagugcgugguggacaaggacaagagaaaccagugcagauacugcagacugaagaagugcuucagagccggcaugaagaaggaggccgugcagaacgagagagacagaaucagcaccagaagaagcagcuacgaggacagcagccugcccagcaucaacgcccugcugcaggccgaggugcugagcagacagaucaccagccccgugagcggcaucaacggcgacaucagagccaagaagaucgccagcaucgccgacgugugcgagagcaugaaggagcagcugcuggugcugguggagugggccaaguacauccccgccuucugcgagcugccccuggacgaccagguggcccugcugagagcccacgccggcgagcaccugcugcugggcgccaccaagagaagcaugguguucaaggacgugcugcugcugggcaacgacuacaucgugcccagacacugccccgagcuggccgagaugagcagagugagcaucagaauccuggacgagcuggugcugcccuuccaggagcugcagaucgacgacaacgaguacgccuaccugaaggccaucaucuucuucgaccccgacgccaagggccugagcgaccccggcaagaucaagagacugagaagccaggugcaggugagccuggaggacuacaucaacgacagacaguacgacagcagaggcagauucggcgagcugcugcugcugcugcccacccugcagagcaucaccuggcagaugaucgagcagauccaguucaucaagcuguucggcauggccaagaucgacaaccugcugcaggagaugcugcugggcggcagccccagcgacgccccccacgcccaccacccccugcacccccaccugaugcaggagcacaugggcaccaacgugaucguggccaacaccaugcccacccaccugagcaacggccagaugugcgaguggcccagacccagaggccaggccgccacccccgagaccccccagcccagcccccccggcggcagcggcagcgagcccuacaagcugcugcccggcgccguggccaccaucgugaagccccugagcgccaucccccagcccaccaucaccaagcaggaggugaucuga

SEQ ID NO: 170 - RNA, 630 nt, Artificial Sequence
  derived and/or modified CDS sequence (opt4) from Homo sapiens__NP_061986.1__HsFGF21
auggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcuga

SEQ ID NO: 171 - RNA, 1356 nt, Artificial Sequence
  derived and/or modified CDS sequence (opt4) from Homo sapiens__NP_078852.3__HsOGFRL1
augggcaaccugcugggcggcgugagcuucagagagcccaccaccguggaggacugcgacagcaccuggcagaccgacagcgagcccgagcccgaggagcccggccccggcggcggcagcgagggccccggccaggagagcgagcagcccgcccagccccccgagcaggccggcggcagacccggcgccagccccgcccccgacgaggacgccgaggccgccggcgccgagcagggcggcgacagcaccgaggccaccgccaagcccaagagaagcuucuacgccgccagagaccuguacaaguacagacaccaguaccccaacuucaaggacaucagauaccagaacgaccugagcaaccugagauucuacaagaacaagauccccuucaagcccgacggcguguacaucgaggaggugcugagcaaguggaagggcgacuacgagaagcuggagcacaaccacaccuacauccaguggcuguucccccugagagagcagggccugaacuucuacgccaaggagcugaccaccuacgagaucgaggaguucaagaagaccaaggaggccaucagaagauuccugcuggccuacaagaugaugcuggaguucuucggcaucaagcugaccgacaagaccggcaacguggccagagccgugaacuggcaggagagauuccagcaccugaacgagagccagcacaacuaccugagaaucaccagaauccugaagagccugggcgagcugggcuacgagagcuucaagagcccccuggugaaguucauccugcacgaggcccugguggagaacaccauccccaacaucaagcagagcgcccuggaguacuucguguacaccaucagagacagaagagagagaagaaagcugcugagauucgcccagaagcacuacacccccagcgagaacuucaucuggggcccccccagaaaggagcagagcgagggcagcaaggcccagaagaugagcagcccccuggccagcagccacaacagccagaccagcaugcacaagaaggccaaggacagcaagaacagcagcagcgccgugcaccugaacagcaagaccgccgaggacaagaagguggcccccaaggagcccguggaggagaccgacagacccagccccgagcccagcaacgaggccgccaagcccagaaacaccgagaaggacagcaacgccgagaacaugaacagccagcccgagaagaccgugaccacccccaccgagaagaaggagagcgugagccccgagaacaacgaggagggcggcaacgacaaccaggacaacgagaaccccggcaacaccaacugccacgacguggugcuggugcaguga

SEQ ID NO: 172 - RNA, 558 nt, Artificial Sequence
  derived and/or modified CDS sequence (opt4) from Homo sapiens__NP_008842.1__HsRLN1
augcccagacuguuccuguuccaccugcuggaguucugccugcugcugaaccaguucagcagagccguggccgccaaguggaaggacgacgugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaucaucaugcuggaguucaucgccaaccugccccccgagcugaaggccgcccugagcgagagacagcccagccugcccgagcugcagcaguacgugcccgcccugaaggacagcaaccugagcuucgaggaguucaagaagcugaucagaaacagacagagcgaggccgccgacagcaaccccagcgagcugaaguaccugggccuggacacccacagccagaagaagagaagacccuacguggcccuguucgagaagugcugccugaucggcugcaccaagagaagccuggccaaguacugcuga

SEQ ID NO: 173 - RNA, 558 nt, Artificial Sequence
  derived and/or modified CDS sequence (opt4) from Homo sapiens__NP_604390.1__HsRLN2
augcccagacuguucuucuuccaccugcugggcgugugccugcugcugaaccaguucagcagagccguggccgacagcuggauggaggaggugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugaucagaaacagacagagcgaggccgccgacagcagccccagcgagcugaaguaccugggccuggacacccacagcagaaagaagagacagcuguacagcgcccuggccaacaagugcugccacgugggcugcaccaagagaagccuggccagauucugcuga

SEQ ID NO: 174 - RNA, 429 nt, Artificial Sequence
  derived and/or modified CDS sequence (opt4) from Homo sapiens__NP_543140.1__HsRLN3
auggccagauacaugcugcugcugcugcuggccgugugggugcugaccggcgagcuguggcccggcgccgaggccagagccgcccccuacggcgugagacugugcggcagagaguucaucagagccgugaucuucaccugcggcggcagcagauggagaagaagcgacauccuggcccacgaggccaugggcgacaccuuccccgacgccgacgccgacgaggacagccuggccggcgagcuggacgaggccaugggcagcagcgaguggcuggcccugaccaagagcccccaggccuucuacagaggcagacccagcuggcagggcacccccggcgugcugagaggcagcagagacgugcuggccggccugagcagcagcugcugcaaguggggcugcagcaagagcgagaucagcagccugugcuga

SEQ ID NO: 175 - RNA, 1410 nt, Artificial Sequence
  derived and/or modified CDS sequence (opt4) from Homo sapiens__NP_002412.1__HsMMP1
augcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacuga

SEQ ID NO: 176 - RNA, 1170 nt, Artificial Sequence
  derived and/or modified CDS sequence (opt4) from Homo sapiens__NP_002412.1__HsMMP1(1-19,100-469)
augcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacuga

SEQ ID NO: 177 - RNA, 3357 nt, Artificial Sequence
  derived and/or modified CDS sequence (opt4) from Clostridium histolyticum__BAA77453.1__ColG
augaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 178 - RNA, 3081 nt, Artificial Sequence
  derived and/or modified CDS sequence (opt4) from Clostridium histolyticum__BAA77453.1__HsALB(1-18)_ColG(111-1118)
augaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 179 - RNA, 3429 nt, Artificial Sequence
  derived and/or modified CDS sequence (opt4) from Clostridium histolyticum__BAA77453.1__HsALB(1-18)_ColG(1-110)_CS-F_ColG(111-1 118)
augaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 180 - RNA, 3105 nt, Artificial Sequence
  derived and/or modified CDS sequence (opt4) from Clostridium histolyticum__BAA34542.1__ColH
augaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 181 - RNA, 3066 nt, Artificial Sequence
  derived and/or modified CDS sequence (opt4) from Clostridium histolyticum__BAA34542.1__ColH
augaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 182 - RNA, 3000 nt, Artificial Sequence
  derived and/or modified CDS sequence (opt4) from Clostridium histolyticum__BAA34542.1__HsALB(1-18)_ColH(41-1021)
augaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 183 - RNA, 3138 nt, Artificial Sequence
  derived and/or modified CDS sequence (opt4) from Clostridium histolyticum__BAA34542.1__HsALB(1-18)_ColH(1-40)_CS-F_ColH(41-102 1)
augaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 184 - RNA, 54 nt, Artificial Sequence
  derived and/or modified CDS sequence (opt5) from Homo sapiens__NP_000468.1__signal peptide-HsALB
augaagugggugaccuucaucagccugcucuuucuguucuccucugccuacagc

SEQ ID NO: 185 - RNA, 96 nt, Artificial Sequence
  derived and/or modified CDS sequence (opt5) from Artificial__1GCM_A__isoleucinze zipper-ILZ
agaaugaagcagaucgaggacaaaauugaagagauccugagcaagauuuaccacaucgaaaacgagauugcccggaucaaaaagcucaucggcgaa

SEQ ID NO: 186 - RNA, 18 nt, Artificial Sequence
  derived and/or modified CDS sequence (opt5) from Artificial____cleavage site-Furin
agacggcgcagaaagcgg

SEQ ID NO: 187 - RNA, 846 nt, Artificial Sequence
  derived and/or modified CDS sequence (opt5) from Homo sapiens__NP_003801.1__HsTNFSF10
auggccaugauggaggugcagggcgggcccagccugggacaaaccugcguccucaucguuauuuucacagugcugcuucagucccuguguguggcugucacguacguguauuuuaccaacgaacucaagcagaugcaggacaaauacucuaagagcggcaucgccugcuuccugaaagaggaugacuccuauugggauccuaaugacgaagagucuaugaacagcccguguuggcaaguuaaguggcagcuuagacagcuggugcggaaaaugauucuccgcacauccgaagagaccaucucuacaguccaggagaagcaacagaauauuagcccccuggugagagaacgggggccucagcgcguugcggcucacaucaccggaacaagaggccgguccaacacccugagcucucccaauuccaagaacgagaaagcccucgggcgcaagaucaauagcugggaaucuuccagaagcggacauucuuuucuguccaaccuucaucugcggaauggcgagcucgugauucacgagaaaggcuucuacuauaucuacagccagacguauuuucgcuuccaagaagagauuaaggaaaacaccaaaaaugauaagcagaugguccaguacaucuacaaguauacauccuacccugaccccauucugcuuaugaaaucugccagaaacagcugcugguccaaggaugcugaguaugggcuguacagcaucuaucaaggaggcauuuuugaacucaaagagaaugaccggaucuucgugucugugaccaacgagcaccugaucgauauggaccaugaagccuccuuuuucggggcuuuucuggucggauga

SEQ ID NO: 188 - RNA, 564 nt, Artificial Sequence
  derived and/or modified CDS sequence (opt5) from Homo sapiens__NP_003801.1__HsTNFSF10(95-281)
accagcgaggaaacaaucuccacggugcaggagaagcaacagaacauuucuccccuggucagagaacggggcccucagcgcguugccgcucacaucaccgggacaagaggacggagcaauacccucuccucuccgaacagcaaaaaugagaaggcccugggccgcaaaauuaacuccugggaaucuagcagauccgggcauagcuuccuuucuaaucugcaccuccggaacggagagcuggugauccaugagaagggcuuuuacuauauuuacucccagacauauuuccgcuuucaagaagagaucaaagaaaauaccaagaacgacaagcagauggugcaguacaucuauaaauacacaagcuaucccgauccuauucuucugaugaagucugcgagaaauuccugcuggagcaaagacgcugaguacgggcucuacucuaucuaucagggaggcauuuucgagcugaaggaaaacgaucggaucuuugucuccgugaccaaugagcaccugauugacauggaucaugaagccagcuucuuuggcgccuuccucguuggguga

SEQ ID NO: 189 - RNA, 618 nt, Artificial Sequence
  derived and/or modified CDS sequence (opt5) from Homo sapiens__NP_003801.1__HsALB(1-18)_HsTNFSF10(95-281)
augaagugggugaccuucaucagccugcucuuucuguucuccucugccuacagcacauccgaggaaacgauuucuaccguccaggagaaacaacagaacaucagcccccuuguuagagaacggggcccucagcgcguggcugcccacauuacagggaccagaggacgguccaauacacugucuagcccgaacuccaagaaugagaaagcgcucggccgcaagaucaacagcugggaaucuuccagaagcgggcauucuuuucuguccaaucuucaucugcggaacggagagcucgugauucacgagaaaggcuucuauuacaucuauagccagaccuacuuucgcuuccaagaagagaucaaggaaaauacaaagaacgacaaacagaugguccaguauauuuacaaguauaccucuuaccccgauccuauccugcugaugaaauccgcuagaaauagcugcugguccaaggacgccgaguacgggcucuauucuauuuaccagggaggcaucuuugagcugaaagaaaacgaucggauuuucgugagcguuacgaaugagcaccuuaucgacauggaucaugaagccuccuuuuucggcgcuuuucuggugggguga

SEQ ID NO: 190 - RNA, 714 nt, Artificial Sequence
  derived and/or modified CDS sequence (opt5) from Homo sapiens__NP_003801.1__HsALB(1-18)_ILZ_HsTNFSF10(95-281)
augaagugggugaccuucaucagccugcucuuucuguucuccucugccuacagcagaaugaaacagauugaggacaagaucgaagagauucuuuccaaaaucuaucacauugaaaacgagaucgcucggaucaagaaacugauuggcgaaacaucugaggagacgaucagcaccguccaagaaaagcagcagaauauuucuccccucguucgcgagagagggccucagcggguggccgcgcauaucacaggaacccgcggcagauccaacacacugagcuccccgaauagcaagaacgaaaaagcucuugggcggaagauuaauucuugggaguccagccgcucuggacacuccuuucugagcaaccuccaucugagaaauggcgagcuggugauccacgaaaaaggguucuacuauauuuacucucaaaccuauuuucgguuccaggaggaaaucaaggagaacaccaaaaaugauaagcagaugguccaguacaucuauaaguacacauccuaccccgacccuauucuccugaugaaaagcgcccgcaacuccugcuggucuaaggaugccgaauauggacuuuacagcaucuaucaaggcggcauuuuugagcugaaagagaaugacagaaucuucguguccguuacgaacgaacaucucauugauauggaccacgaggcuagcuuuuucggggccuuucuggugggauga

SEQ ID NO: 191 - RNA, 1077 nt, Artificial Sequence
  derived and/or modified CDS sequence (opt5) from Rattus norvegicus__NP_036656.1__RnCebpa
auggagagcgccgacuucuacgaagcugagcccagaccuccgauguccucucaucugcagagcccuccccacgcccccuccaacgcggcuuuuggcuucccucgcggggccggacccgccccuccgcccgcuccucccgccgcuccugaaccccucggcgggaucugcgagcacgaaaccucuauugauaucagcgccuauauugacccggcggccuuuaaugaugaguuccuggcugaccuuuuucaacauucccggcagcaggagaaggccaaagcugccgcgggaccugccggcgggggaggcgauuucgacuaccccggcgcuccugccgggcccggaggcgcugugaugucugccggggcccacggacccccuccgggcuaugggugugcugcggccggauaccuggauggcagacucgaaccccuguaugagcgggucggcgcuccugcccuucgcccccugguuaucaagcaggaaccuagagaggaggacgaagccaaacaacucgcucuggccgggcuguuucccuaccagccgccucccccucccccucccccgcauccucacgcgagccccgcucaccucgccgcuccccaucugcaguuccagauugcccacugcggacaaacaacgaugcaucuucagccuggccacccgacacccccucccaccccugugcccuccccucaccccgccccggcuaugggggccgcgggacugccuggccccgggggaagccucaagggccuggccggcccucaucccgaucuucggaccgggggaggcgggggaggcggggcuggcgccggaaaagcuaagaagucuguggacaaaaacuccaaugaguaucgcgucagacgggaacgcaacaauaucgccgugagaaagagccgggauaaagcgaagcagcgcaacguugagacacagcaaaaagugcuggaacucaccucugacaaugauagacugcggaagcgcgucgagcagcuguccagagagcucgacacacugcggggcaucuuuagacagcuuccggaaagcucucuggugaaggccauggggaacugugcuuga

SEQ ID NO: 192 - RNA, 1035 nt, Artificial Sequence
  derived and/or modified CDS sequence (opt5) from Rattus norvegicus__NP_036656.1__RnCebpa(15-344)
augagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacccugcccccgcuaugggggccgcuggacugccuggccccgggggaucccucaagggccuggccggcccgcauccugaccuuagaaccgggggaggcgggggaggcggggcgggcgccggaaaagcuaaaaagagcguggauaagaacucuaaugaguaccggguccgcagagagcggaacaauaucgccgugcgcaaguccagagacaaagcuaagcagcggaacguugaaacacagcaaaaagugcuggagcucaccagcgauaaugaccgccugagaaagcgggucgaacagcugucucgcgagcucgauacacugagaggcaucuuccggcagcuucccgaauccagccuggugaaggccauggggaacugugcguga

SEQ ID NO: 193 - RNA, 1080 nt, Artificial Sequence
  derived and/or modified CDS sequence (opt5) from Mus musculus__NP_031704.2 __MmCebpa
auggagagcgccgacuucuacgaaguggagcccagaccuccgauguccucucaucugcagagcccuccccacgcucccuccaacgccgcguuuggcuucccucgcggggcuggacccgccccuccgcccgccccucccgcugccccugaaccccucggcgggaucugcgagcacgaaaccucuauugauaucagcgcuuauauugacccggccgcguuuaaugaugaguuccuggccgaccuuuuucaacauucccggcagcaggagaaggcuaaagccgcugccggaccugcgggcgggggaggcgauuucgacuaccccggcgccccugcugggcccggaggcgccgucaugucugcuggggcccacggacccccuccgggcuaugggugugccgcugcgggauaccuggauggcagacucgaaccccuguaugagcggguuggcgccccugcccuucgcccccuggugaucaagcaggaaccuagagaggaggacgaagccaaacaacucgcccuggcugggcuguuucccuaccagccgccucccccucccccucccccgcauccucacgccagccccgcgcaccucgcugcuccccaucugcaguuccagauugcccacugcggacaaacaacgaugcaucuucagccuggccacccgacacccccucccaccccugugcccuccccucacgcugcccccgcucugggggccgcgggacucccgggcccugggagcgcccugaagggacuugcuggcgcccaucccgaucugcggaccggcgggggaggcgggggaucuggcgcuggggccggcaaagcgaagaaguccgucgacaaaaacagcaaugaguaucgcgugagacgggaacgcaacaauaucgccguuagaaagucucgggauaaagcuaagcagcgcaacguggagacacagcaaaaaguccucgaacugaccuccgacaaugauagacugcggaagcgcguggagcagcucagcagagagcuggacacacuucggggaaucuuuagacagcugccugaaucuucccucguuaaggccaugggcaacugugcuuga

SEQ ID NO: 194 - RNA, 1038 nt, Artificial Sequence
  derived and/or modified CDS sequence (opt5) from Mus musculus__NP_031704.2 __MmCebpa(15-359)
augagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacgccgcuccugcccugggggcugccggacuccccggcccuggguccgcgcugaagggacuugccggcgcucaucccgaccugagaaccggcgggggaggcgggggaagcggcgccggggcuggcaaagccaagaagucuguggauaaaaacuccaaugaguaccggguccgcagagagcggaacaauaucgcggugcgcaagagcagagacaaagccaagcagcggaacguugaaacacagcaaaaagugcucgagcugaccucugauaaugaccgccugagaaagcgggucgaacagcucucccgcgagcuggauacacuuagaggaaucuuccggcagcugccggaaagcucucucgugaaggcuaugggcaacugugccuga

SEQ ID NO: 195 - RNA, 1077 nt, Artificial Sequence
  derived and/or modified CDS sequence (opt5) from Homo sapiens__NP_004355.2__HsCEBPA
auggagagcgccgacuucuacgaagcugagcccagaccuccgauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcguga

SEQ ID NO: 196 - RNA, 1035 nt, Artificial Sequence
  derived and/or modified CDS sequence (opt5) from Homo sapiens__NP_004355.2__HsCEBPA(15-358)
auguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcguga

SEQ ID NO: 197 - RNA, 1425 nt, Artificial Sequence
  derived and/or modified CDS sequence (opt5) from Homo sapiens__NP_000448.3__HsHNF4A
augagacugagcaagacccucguggacauggauauggccgacuacuccgcugcccuggaucccgcguauacaacgcuugaguucgaaaacguccagguucugaccaugggcaaugacacaucuccuagcgaggggaccaaccucaaugcuccgaacucccugggagugucugcccuuugcgccaucuguggcgaucgggcuacagggaaacacuacggagccagcuccugcgacggcuguaagggguuuuuccgcagaucugugcggaaaaaucauauguauagcugccgcuuuuccagacaaugugucguggauaaggacaaacggaaccagugccgcuacuguagacugaagaagugcuuccgggcuggaaugaaaaaggaagccguucagaaugagcgcgauagaauuagcacccggcgcagcuccuaugaagacagcucucuccccuccaucaacgcgcugcugcaggccgaggugcucagcagacaaauuacaucuccugucuccggcaucaauggcgauauucgggcuaaaaagaucgccagcaucgcugacgugugugaguccaugaaagaacagcugcuuguucugguggagugggccaaguacauucccgcguuuugcgaacucccucuggaugaccaggucgcccuucugcgcgcucacgccggggagcaucuccugcugggagcuaccaagagaucuaugguguucaaagacgugcuccugcuuggcaacgauuauaucgucccccggcacuguccugagcuggccgaaaugagcagaguuuccauucgcauccucgacgagcuggugcuuccguuucaggaacugcaaauugaugacaaugaguacgccuaccucaaggcuaucauuuucuuugaucccgacgcgaaagggcugagcgauccuggaaagaucaaacggcugagaucucaggugcaggucucccucgaagacuauaucaacgaucgccaguacgacagccggggcagauucggggagcugcuucugcuccugcccacgcuucaaucuauuaccuggcagaugaucgagcagauucaauuuaucaagcuguucggaauggccaaaauugauaaucuccugcaggaaaugcugcucggcggcagcccuuccgacgcuccccaugcccaccacccgcugcauccucaccuuaugcaggagcauauggggacaaacgugaucguugccaauaccaugcccacacaccugucuaacggacagaugugcgaauggccucgcccccggggccaagcugccacccccgagacgccucagccgucucccccugggggauccggcagcgaacccuauaagcuccugccuggggcgguggcuacaaucgucaagccccugucugccauuccgcagccuaccaucacaaaacaggaggugauuuga

SEQ ID NO: 198 - RNA, 630 nt, Artificial Sequence
  derived and/or modified CDS sequence (opt5) from Homo sapiens__NP_061986.1__HsFGF21
auggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuuga

SEQ ID NO: 199 - RNA, 1356 nt, Artificial Sequence
  derived and/or modified CDS sequence (opt5) from Homo sapiens__NP_078852.3__HsOGFRL1
augggcaaccugcucgggggagugagcuucagagagcccaccacagucgaagacugcgauuccacguggcagaccgacucugagccugaaccggaggaacccggcccugggggaggcagcgaggggcccggacaagaguccgaacagccugcccagcccccugagcaggcuggcggccggccgggggccucucccgcgccugaugaagacgcugaggccgccggagcugagcaaggcggggauagcacagaagccaccgcuaagcccaaacgcuccuuuuacgccgcgagagaccuguauaaguaccggcaccaguauccuaauuucaaagauauccgcuaccagaacgaccuuucuaaucugagauuuuauaagaacaaaauucccuucaagccggauggaguuuacaucgaggaagugcucagcaaguggaaaggcgacuaugagaagcuggaacauaaucacacauacauucaguggcuuuuuccucugcgggagcaagggcucaacuucuacgccaaagagcugaccacauaugaaaucgaggaauuuaagaaaaccaaggaggcuauucgcagauuccugcucgccuacaagaugaugcuggaauuuuucggaaucaaacuuacggauaagaccggcaauguggcucgggccgucaacuggcaggagcgcuuucagcaucugaaugagucccagcacaacuaucucagaaucacacggauucugaaaagccuuggcgaacugggguacgagucuuucaagucuccccucgugaaauuuauccugcaugaagcgcugguugagaauaccauuccuaacaucaagcaaagcgcccucgaauauuucguguacacaauucgcgacagacgggagcgcagaaaacugcuucgguucgcucagaagcacuauacccccucugagaauuuuaucuggggacccccuagaaaggaacaguccgagggcagcaaagcccaaaagaugucuuccccgcuggcuagcucccacaacucucagacgagcaugcauaaaaaggccaaagauuccaagaauagcuccuccgccguccaccucaacagcaagacagcugaagacaaaaagguggcgcccaaagagccuguugaggaaaccgaccgccccucuccugagcccagcaacgaagccgcuaagccgcggaauacagagaaagauuccaacgccgaaaauaugaacucucagccugagaagaccgugaccacacccacggagaagaaagaaagcgucuccccugagaauaacgaagaagggggaaaugacaaccaggauaaugagaaccccggcaauaccaacugucaugacguggugcugguccaauga

SEQ ID NO: 200 - RNA, 558 nt, Artificial Sequence
  derived and/or modified CDS sequence (opt5) from Homo sapiens__NP_008842.1__HsRLN1
augcccagacuguuccucuuucaccuucuugaguucugccugcuccugaaccaguuuagccgggccguggcugccaaguggaaagacgaugucaucaagcuguguggccgcgaacugguuagagcgcaaauugcuaucugcgggauguccaccuggucuaaacggagccucucccaggaggacgccccucagacaccgcgccccguggccgaaauugugccuucuuucaucaauaaggauacggagaccauuaucaucaugcuggaauuuauugcuaaccugcccccugagcucaaagccgcucugagcgagagacagcccucccuuccugaacugcaacaguacgucccggcccucaaggacucuaaucugagcuucgaggaauuuaagaaacuuauccggaaccgccaguccgaggcggccgauagcaaucccucugagcugaaguaucucggacuggacacacauucccagaaaaagagacggccuuacguggcucuguucgaaaaauguugccucauuggcuguaccaagcgcagccuggccaaguauugcuga

SEQ ID NO: 201 - RNA, 558 nt, Artificial Sequence
  derived and/or modified CDS sequence (opt5) from Homo sapiens__NP_604390.1__HsRLN2
augcccagacuguucuuuuuccaccuccugggcgugugccuucugcucaaccaguuuagccgggccgucgcugacuccuggauggaggaaguuaucaagcugugugggcgcgagcuugugagagcccaaauugcgaucugcggaaugucuaccuggagcaaacggucccugucucaggaagaugcuccucagacaccgcgccccguggccgagauugucccuagcuucaucaauaaggacacggaaaccauuaacaugauguccgaguuuguggccaaucucccccaggagcugaaacugacacucucugaaaugcaaccugcucugccccagcuucagcagcauguuccugugcugaaggauagcucccuccuguucgaggaauuuaaaaagcugaucagaaaccggcaaagcgaggccgcugacucuuccccgagcgagcuuaaguaccucggccuggauacccacucucgcaaaaagagacagcuguauuccgcccucgcgaauaaauguugccaugucggguguacaaagcggagccuggcccgcuucugcuga

SEQ ID NO: 202 - RNA, 429 nt, Artificial Sequence
  derived and/or modified CDS sequence (opt5) from Homo sapiens__NP_543140.1__HsRLN3
auggccagauacaugcugcuccugcuucuggcuguguggguccucaccggcgagcuguggcccggggccgaagcgcgggcugccccuuauggaguucgccuuugcggcagagaguucauccgggccgugauuuuuacaugugggggaagccgcuggagacgguccgacauccuggcucacgaagccaugggcgauacguucccggacgcugaugccgacgaggauucucucgcgggggaacuggacgaggccaugggaagcuccgaguggcuggcucucaccaagucuccccaggccuuuuaccgcggcagaccuagcuggcaaggcacacccggggugcugcggggaucccgcgauguccuugcuggccugucuagcuccugcuguaaaugggggugcagcaagucugaaauuuccagccucuguuga

SEQ ID NO: 203 - RNA, 1410 nt, Artificial Sequence
  derived and/or modified CDS sequence (opt5) from Homo sapiens__NP_002412.1__HsMMP1
augcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacuga

SEQ ID NO: 204 - RNA, 1170 nt, Artificial Sequence
  derived and/or modified CDS sequence (opt5) from Homo sapiens__NP_002412.1__HsMMP1(1-19,100-469)
augcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauuga

SEQ ID NO: 205 - RNA, 3357 nt, Artificial Sequence
  derived and/or modified CDS sequence (opt5) from Clostridium histolyticum__BAA77453.1__ColG
augaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaauga

SEQ ID NO: 206 - RNA, 3081 nt, Artificial Sequence
  derived and/or modified CDS sequence (opt5) from Clostridium histolyticum__BAA77453.1__HsALB(1-18)_ColG(111-1118)
augaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaaguga

SEQ ID NO: 207 - RNA, 3429 nt, Artificial Sequence
  derived and/or modified CDS sequence (opt5) from Clostridium histolyticum__BAA77453.1__HsALB(1-18)_ColG(1-110)_CS-F_ColG(111-1 118)
augaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaaguga

SEQ ID NO: 208 - RNA, 3105 nt, Artificial Sequence
  derived and/or modified CDS sequence (opt5) from Clostridium histolyticum__BAA34542.1__ColH
augaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcuga

SEQ ID NO: 209 - RNA, 3066 nt, Artificial Sequence
  derived and/or modified CDS sequence (opt5) from Clostridium histolyticum__BAA34542.1__ColH
augaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagauga

SEQ ID NO: 210 - RNA, 3000 nt, Artificial Sequence
  derived and/or modified CDS sequence (opt5) from Clostridium histolyticum__BAA34542.1__HsALB(1-18)_ColH(41-1021)
augaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcuga

SEQ ID NO: 211 - RNA, 3138 nt, Artificial Sequence
  derived and/or modified CDS sequence (opt5) from Clostridium histolyticum__BAA34542.1__HsALB(1-18)_ColH(1-40)_CS-F_ColH(41-102 1)
augaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcuga

SEQ ID NO: 212 - RNA, 54 nt, Artificial Sequence
  derived and/or modified CDS sequence (opt6) from Homo sapiens__NP_000468.1__signal peptide-HsALB
augaaauggguuacuuuuauuucucuucuuuuucuuuuuucuucugcuuacucu

SEQ ID NO: 213 - RNA, 96 nt, Artificial Sequence
  derived and/or modified CDS sequence (opt6) from Artificial__1GCM_A__isoleucinze zipper-ILZ
agaaugaaacaaauagaagacaaaauagaagaaauacuaucaaaaauauaccacauagaaaacgaaauagcaagaauaaaaaaacuaauaggagaa

SEQ ID NO: 214 - RNA, 18 nt, Artificial Sequence
  derived and/or modified CDS sequence (opt6) from Artificial____cleavage site-Furin
agaaggaggagaaaaaga

SEQ ID NO: 215 - RNA, 846 nt, Artificial Sequence
  derived and/or modified CDS sequence (opt6) from Homo sapiens__NP_003801.1__HsTNFSF10
auggcaaugauggaaguacaaggaggaccaucacuaggacaaacaugcguacuaauaguaauauucacaguacuacuccaaucacuaugugucgcagucacauacguauacuucacaaacgaauuaaaacaaaugcaagauaaauacucaaaaucaggaauagcuugcuucuuaaaagaagacgacucauacugggaccccaacgacgaagaaucaaugaauagcccaugcuggcaaguaaaauggcaacuaagacaauuaguaagaaaaaugauacuaagaacaucagaagaaacaauaucaacaguacaagaaaaacaacaaaacauaucaccccuaguaagagaaagaggaccacaaagaguagcagcacacauaacaggaacaagaggaagaagcaacacacuaucaaguccaaacagcaaaaacgaaaaagcacucggaagaaaaauaaacucaugggaauccagcagaagcggacacucauucuuaucaaaccuacauuuacgaaauggagaauuaguaauacacgaaaaaggauucuacuacauauacucacaaaccuacuucagauuccaagaagaaauaaaagaaaacaccaaaaacgacaaacaaaugguacaauacauauacaaauacacaucauauccagacccaauacuauuaaugaaaucagcaagaaauagcugcuggucaaaagacgcagaauacggacuauacucaauauaccaaggcggaauauucgaauuaaaagaaaacgacagaauauucguaucaguaacaaacgaacaccuaauagacauggaccacgaagcaaguuucuucggugcauucuuaguaggcuaa

SEQ ID NO: 216 - RNA, 564 nt, Artificial Sequence
  derived and/or modified CDS sequence (opt6) from Homo sapiens__NP_003801.1__HsTNFSF10(95-281)
acaagcgaagaaacaauaagcacaguacaagaaaaacaacaaaacauaagcccccuaguaagagaaagaggaccacaacgaguagcagcacacauaacaggaacaagaggaagaucaaacacacuaagcucaccaaacaguaaaaacgaaaaagcauuaggaagaaaaauaaacucaugggaaucaagcagaagcggacacucauucuuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaaguuacccagacccaauacuacuaaugaaaucagcaagaaacagcugcuggucaaaagacgccgaauacggacuauacucaauauaccaaggaggaauauucgaacuaaaagaaaacgacagaauauucgucucaguaacaaacgaacacuuaauagacauggaccacgaagcaucauucuucggagcauuccuaguaggauaa

SEQ ID NO: 217 - RNA, 618 nt, Artificial Sequence
  derived and/or modified CDS sequence (opt6) from Homo sapiens__NP_003801.1__HsALB(1-18)_HsTNFSF10(95-281)
augaaauggguaacauucauauccuuacuauuccuauucucaucagcauacucaacaucagaagaaacaauaucaacaguacaagaaaaacaacaaaacauauccccacuuguaagagaacgaggaccacaaagaguagcagcacacauaacaggaacaagaggaagauccaacacacuaucauccccaaacucaaaaaacgaaaaagcacuaggaagaaaaauaaacucaugggaaucauccagaucaggacacagcuuccuaucaaacuuacacuuaagaaacggagaacuuguaauacacgaaaaaggauucuacuacauauacucacaaacauacuucagauuccaagaagaaauaaaagaaaacacaaaaaacgacaaacaaaugguacaauacauauacaaauauacaucauacccagacccaauacuacuaaugaaaucagcaagaaacucaugcuggucaaaagacgcagaauacggacuauacagcauauaccaaggaggaauauucgaacuaaaagaaaacgacagaauauucguaucaguaacaaacgaacacuuaauagacauggaccacgaagcauccuucuucggagccuuccuaguaggauaa

SEQ ID NO: 218 - RNA, 714 nt, Artificial Sequence
  derived and/or modified CDS sequence (opt6) from Homo sapiens__NP_003801.1__HsALB(1-18)_ILZ_HsTNFSF10(95-281)
augaaauggguaacauucauaucacucuuauucuuauucucaagcgcauacucaagaaugaaacaaauagaagacaaaauagaagaaauauuaucaaaaauauaccauaucgaaaacgaaauagcaagaauaaaaaaauuaauaggagaaacaucagaagaaacaauaagcacgguacaagaaaaacaacaaaacauaagcccacuuguaagagaaagaggaccacaaagaguagcagcacacauaaccggaacaagaggcagaagcaauacacuaucaucaccaaauagcaaaaacgaaaaagcacuaggaagaaaaauaaacaguugggaaucaagcagaagcggacacucauuccuaagcaaccuacaccuaaggaacggagaauuaguaauacacgaaaaaggauuuuacuacauauacucacaaacauacuucagauuccaagaagaaauaaaagaaaacacaaaaaacgacaaacaaaugguacaauacauauacaaauacacaagcuauccagacccaauacuacuaaugaaaagugcaagaaauagcugcuggucaaaagacgccgaauacggacuauacagcauauaccaaggaggaauauucgaauuaaaagaaaacgaccgaauauuuguaaguguaacaaacgaacaccuaauagacauggaccacgaagcuagcuucuucggagcauuccuaguaggauaa

SEQ ID NO: 219 - RNA, 1077 nt, Artificial Sequence
  derived and/or modified CDS sequence (opt6) from Rattus norvegicus__NP_036656.1__RnCebpa
auggaaucagcugacuuuuaugaagcagaaccaagaccaccaaugucuucacaucuacaaaguccuccacaugcaccaucuaaugcagcuuuuggauuuccaagaggagcaggaccugcaccaccaccagcaccuccagcagcucccgaaccccuaggagguauaugugaacaugaaacaaguauagauauaagugcauacauagauccagcagcauuuaacgacgaauuuuuagcugaccuauuucaacauuccagacaacaagaaaaagcaaaagcugcagccggaccagcaggaggaggaggugauuucgacuauccaggagcaccagcaggaccuggcggagcaguaaugucagcaggagcacauggaccaccaccuggauacggaugugcagcagcuggauauuuagacggaagauuagaaccauuauaugaaagaguaggagcaccagcauuacguccauuaguaauaaaacaagaaccaagagaagaagacgaagcaaaacaacuagcacuugcagguuuauuuccauaucaaccaccuccuccaccaccaccaccacacccacacgccucaccagcacauuuagcagcaccucaucuacaauuucaaauagcacauuguggacaaacgacuaugcaucuacaaccaggacauccaacaccaccaccaacaccaguuccaucaccucauccagcacccgcuaugggagcagcaggccuaccaggaccaggagguucgcuaaaaggacucgcaggaccccauccagauuuaagaacaggagguggaggaggaggaggagcaggagcuggaaaagcaaaaaaaucaguagauaaaaacucaaacgaauacagagucagaagagaaagaaauaauauagcuguaagaaaaucaagagacaaagcaaaacaaagaaauguagaaacacaacaaaaaguacuugaauuaacaucugacaaugauagauuaagaaaaagaguagaacaauuaucaagagaacuagacacacuaagaggaauauuuagacaacuaccagaaucaagcuuaguuaaagccauggguaauugugcuuaa

SEQ ID NO: 220 - RNA, 1035 nt, Artificial Sequence
  derived and/or modified CDS sequence (opt6) from Rattus norvegicus__NP_036656.1__RnCebpa(15-344)
augaguucacauuuacaaagccccccucaugcaccaucaaaugcagcauuuggauucccaagaggugcaggaccagcaccuccaccagcaccaccagcugcaccagaaccucuaggaggaauaugugaacaugaaacaucuauagauauaucagcauauauagauccugcagcauucaaugaugaauuuuuagcagauuuauuucaacacucaagacaacaagaaaaagcaaaagcagcagcuggaccagcagguggaggaggagacuuugauuauccaggagcaccagcagguccuggcggagcaguaaugucagcaggagcacauggacccccuccuggauauggaugugcagcagcuggauauuuagacggaagauuagaaccauuauacgaaagaguaggagcaccugcauuaagaccauuaguaaucaaacaagaaccaagggaagaagaugaagcaaaacaauuagcauuagcuggauuauuuccauaucaaccaccaccaccaccaccaccaccacauccacaugcaucaccagcucauuuagcagcaccacaccuacaauuucaaauagcacauuguggacaaacuacuaugcauuuacaaccaggucauccaacaccaccaccaacaccaguaccaucaccacauccugcuccagcaaugggagcagcaggauuaccaggaccaggaggaucacuuaaagguuuagcaggaccacacccagaucuucgaacaggaggaggaggcggagguggugcaggagcaggaaaagccaaaaaaucaguugacaaaaauagcaaugaauacagaguaagacgagaaagaaauaauauagcaguaagaaaaagcagagauaaagcaaaacaaagaaauguagaaacacaacaaaaaguauuagaauuaacaucagacaaugaucguuuaagaaaacgaguagaacaacuuaguagagaauuagacacauuaagaggaauuuuuagacaauuaccagaaucaucauuaguaaaagcaaugggaaauugugcauaa

SEQ ID NO: 221 - RNA, 1080 nt, Artificial Sequence
  derived and/or modified CDS sequence (opt6) from Mus musculus__NP_031704.2 __MmCebpa
auggaaucagcagauuuuuaugaaguagaaccacgaccaccuaugaguucucacuuacaaaguccaccacacgcaccaucaaaugcugcauuuggcuucccuagaggcgcaggaccagcaccaccuccugcaccaccagccgcaccagaaccauuaggaggaauuugugaacaugaaacaucuauagauauaucagcauauauagacccagcagcauucaaugaugaauuuuuagcagaucuauuccaacacaguagacaacaagaaaaagcuaaagcagcagcaggaccagcaggaggaggcggagacuuugauuauccuggagcaccugcaggaccuggaggugcaguaaugucagcaggugcacaugguccaccaccuggauauggaugugcugcagcaggauaccuagauggaagauuagaaccacuauaugaaagaguuggugcaccugccuuaagaccauuagucauuaaacaagaaccaagagaagaagaugaagcaaaacaauuagcacuagcaggauuauucccauaucaaccaccacccccccccccaccaccacauccacaugcaucaccagcacauuuagcagcuccacauuuacaauuucaaauagcacauuguggccaaacaacuaugcauuugcaaccaggacauccaacaccaccaccaacaccagucccaucuccucacgcugcaccagcacuuggugcagcaggauuaccaggaccaggaagugcacuuaaaggauuggcaggagcccaucccgauuuaagaacaggaggagguggaggaggaaguggagcaggugcaggaaaagcaaaaaaaaguguagauaaaaauagcaacgaauauagaguacgaagagaaagaaauaauauagcaguaagaaaaucaagagauaaagcaaaacaaaggaauguugaaacacaacaaaaaguauuagaauuaacauccgauaaugacagauuacgaaaaagaguagaacaacucucaagagaauuagauacacuaagagguauauuuagacaauuaccagaaucaucauuaguuaaagcaaugggaaauugcgcauaa

SEQ ID NO: 222 - RNA, 1038 nt, Artificial Sequence
  derived and/or modified CDS sequence (opt6) from Mus musculus__NP_031704.2 __MmCebpa(15-359)
augucuagccauuuacaaucaccaccacaugcaccaucaaaugcugcauuuggcuuucccagaggagcagguccugcaccacccccagcuccuccagccgcuccugaaccauuaggaggaauaugugaacaugaaacaucaauagacauuucagcauauauagacccagcagcauuuaaugaugaauuucuagcagauuuauuucaacacagcagacaacaagaaaaagccaaagcagcagcaggaccagcaggaggugguggagauuuugauuacccaggcgcaccagcaggucccggaggugcaguuaugucagccggagcucauggaccaccaccuggcuacggcugugcagcagcaggauauuuagacgguagacuagaaccauuauacgaaagaguaggagccccagcacuaagaccauuaguaauaaaacaagaaccaagagaagaagaugaagcaaaacaauuagcauuagcuggauuauuuccauaucaaccaccaccuccaccuccaccaccacauccccaugcuucaccagcacaucuugcagcaccacauuuacaauuucaaauagcucauuguggacaaacaacaaugcaccuacaaccaggacacccaacaccaccaccuacuccaguaccauccccacaugcugcaccagcacuaggagcagcuggccuuccaggcccaggaucugcacuuaaaggauuagcaggagcucauccggauuuaagaacaggaggaggaggaggaggaucaggagcaggagcagguaaagcuaaaaaaucaguagauaaaaauucaaacgaauacagaguaagacgagaacgaaauaacauagccguaagaaaaucaagagauaaagcaaaacaaagaaacguagaaacacaacaaaaaguauuagaacuaacaagugauaaugaucgacuaagaaaaagaguagaacaacuaucaagagaauuagauacacuucguggaauauuuagacaauuaccagaaucaucauuaguuaaagcaaugggaaauugugcauaa

SEQ ID NO: 223 - RNA, 1077 nt, Artificial Sequence
  derived and/or modified CDS sequence (opt6) from Homo sapiens__NP_004355.2__HsCEBPA
auggaaucagcagauuuuuacgaagcagaaccaagacccccaaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaa

SEQ ID NO: 224 - RNA, 1035 nt, Artificial Sequence
  derived and/or modified CDS sequence (opt6) from Homo sapiens__NP_004355.2__HsCEBPA(15-358)
augucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaa

SEQ ID NO: 225 - RNA, 1425 nt, Artificial Sequence
  derived and/or modified CDS sequence (opt6) from Homo sapiens__NP_000448.3__HsHNF4A
augcgauuaucaaaaacacucguagauauggauauggcggacuacucagcagcauuagaccccgcauauaccacauuagaauuugaaaacguccaaguauuaacaaugggaaaugacacaucucccucagaaggaacaaaccucaacgcaccaaacucucuaggaguaucagcucuaugcgccauaugcggagaccgagccacaggaaaacacuacggagcaucaucaugugacgguugcaaaggauucuucagaagaucuguaagaaaaaaucacauguacucaugcagauucucuagacaaugcguugucgacaaagacaaaagaaaucaaugcagauacugcagacugaaaaaaugcuucagagcaggaaugaaaaaagaagcaguacaaaacgaaagagauagaauuuccacacguagaucuucauaugaagacuccucauuaccaucaauaaaugcacuauuacaagcagaaguacuaucacgacaaauaaccucccccguaucaggaauuaacggagauauaagagcaaaaaaaauagcaucaauagccgauguaugcgagagcaugaaagaacaacuauuaguacuuguagaaugggcaaaauacaucccagcuuuuugcgaauuaccguuagaugaccaaguagcauuauuaagagcacacgcaggagaacaucuauuacucggugcaacaaaaagauccaugguauucaaagacguccuacuucuaggaaacgacuacauaguaccacgccacugccccgaauuagcagaaauguccagaguuaguauaagaauacuagacgaauuaguacuaccauuccaagaacuacaaauagaugacaacgaauaugcauauuuaaaagcaaucaucuucuucgauccagacgcaaaaggacuauccgauccugguaaaauaaaaagguuaagaucacaaguacaaguaucacuugaggauuacaucaacgauagacaauacgacucacgagguagguuuggagaacuauuacuuuuauuaccaaccuuacaaucaaucacauggcaaaugauagaacaaauacaauucaucaaacuauucggaauggccaaaauagacaaccuacuacaagaaauguuauuaggaggaucaccaucugacgcaccacacgcacaccauccacuacacccacaucuaaugcaagaacacauggguacaaacguaauagucgcaaauacaaugccaacacaccuaucuaacggacaaaugugcgaauggccacgcccacgaggacaagcagcaacaccugaaaccccacaaccaucaccacccggagguucaggaucagaaccauacaaacuccuaccuggagcaguagcaacaauaguaaagccauuaucagcaauaccacaaccaacaauaacaaaacaagaaguaauauaa

SEQ ID NO: 226 - RNA, 630 nt, Artificial Sequence
  derived and/or modified CDS sequence (opt6) from Homo sapiens__NP_061986.1__HsFGF21
auggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaa

SEQ ID NO: 227 - RNA, 1356 nt, Artificial Sequence
  derived and/or modified CDS sequence (opt6) from Homo sapiens__NP_078852.3__HsOGFRL1
augggaaauuuauuagguggaguauccuucagagaaccaacaacagucgaagacugugacagcacauggcaaacggacucagaaccagaaccagaagaaccaggaccaggaggaggaucagaaggaccaggucaagaaucagaacaaccagcacaaccaccagaacaagcaggaggaagaccaggugcauccccagccccagacgaagacgcagaagcagccggagcagaacaaggaggugacaguacagaagcuaccgcaaaacccaaacgaucauucuacgcagcaagagaccuuuacaaauacagacaccaguauccaaacuucaaagacauuagauaccaaaaugauuuaagcaaccuacgauuuuauaaaaauaaaauaccauucaaacccgacggagucuacauagaagaaguacuaucaaaauggaaaggcgauuacgaaaaauuagaacauaaccacacauacauacaaugguuauucccacucagagaacaaggauuaaauuuuuaugcaaaagaacuuacaacauacgaaauagaagaauuuaaaaaaacaaaagaagcaauacgcagauuccuacuggcauacaaaaugaugcuagaauuuuucggcauaaaauuaacagacaaaaccggcaacguagcaagagcaguaaacuggcaagaacgauuccaacaucuaaacgaaagccaacacaacuaccugagaauaacacgcauacuaaaaucacuaggagaacuaggcuaugaauccuuuaaaagcccauuaguaaaauucauacuacaugaagccuuaguagaaaacacaauaccaaacauaaaacaaucagcauuagaauacuucguauauacaauaagagacagaagagaaagaagaaagcuauuacgauuugcacaaaaacauuacacacccucagaaaacuucaucuggggcccaccaagaaaagaacaaucagaaggaucaaaagcacaaaaaaugagcucaccacuagcaaguucacauaacucacaaacauccaugcauaaaaaagcaaaagauucaaaaaauuccucaucagcaguacaccuaaacaguaaaacugccgaagacaaaaaaguagcaccaaaagaaccaguagaagaaacagacagacccucaccugaaccuagcaacgaagcagcaaaaccaagaaauacagaaaaagauucaaacgcagaaaauaugaacucacaaccagaaaaaacugucaccacaccaacagaaaaaaaagaaucaguaucaccagaaaauaacgaagaaggaggcaacgauaaccaagacaacgaaaacccagguaacacaaacugucacgacgucguauuaguucaauaa

SEQ ID NO: 228 - RNA, 558 nt, Artificial Sequence
  derived and/or modified CDS sequence (opt6) from Homo sapiens__NP_008842.1__HsRLN1
augccaagacuauucuuauuccaccuauuagaauuuugccuacuacuaaaccaauuuuccagagcaguagcagcaaaauggaaagacgacguaauaaaauuaugcggaagagaacucguaagagcacaaauagcaauaugcggaaugucaacauggucaaaaagaucacuaucacaagaagacgcaccacaaacaccaagaccaguagcagaaauagucccaucauucauaaacaaagacacagaaacaauaauaauaaugcuagaauuuauagcaaacuuaccacccgaacuaaaagcagcacuaucagaaagacaaccaucacuaccagaacuacaacaauacgucccagcacuaaaagacucaaaccuauccuucgaagaauuuaaaaaacucauaagaaacagacaaucagaagcagcagacucaaacccauccgaacuaaaauaccuaggacuagacacacacucacaaaaaaaaagaagaccauacguagcccuauucgaaaaaugcugccuaauaggauguacaaaacgcucacuagcaaaauacugcuaa

SEQ ID NO: 229 - RNA, 558 nt, Artificial Sequence
  derived and/or modified CDS sequence (opt6) from Homo sapiens__NP_604390.1__HsRLN2
augccaagacuauucuucuuccaccuacuaggaguaugccuacuccuaaaccaauucuccagagcaguagcagacucauggauggaagaaguaauaaaacuaugcggaagagaacuuguaagagcacaaauagcaauaugcggaauguccacauggucaaaaagaucacuaucacaagaagacgcaccacaaacaccaagaccaguagcagaaauaguaccaucauucauaaacaaagauacagaaacaauaaacaugaugucagaauuugucgcaaaccuaccacaagaauuaaaacuaacauuaucagaaaugcaaccagcccuaccacaacuacaacaacacguacccguacuaaaagacucaucauuacuauucgaagaauuuaaaaaacuaauaagaaacagacaaucagaagcagcagacagcucaccaucagaauuaaaauaccucggacuagacacacacucaagaaaaaaaagacaauuauacucagcacuagcaaacaaaugcugccacguaggaugcacaaaaagaucacuagccagauucugcuaa

SEQ ID NO: 230 - RNA, 429 nt, Artificial Sequence
  derived and/or modified CDS sequence (opt6) from Homo sapiens__NP_543140.1__HsRLN3
auggcaagauauauguuauuauuauuauuagcaguauggguacuaacaggagaauuauggccaggagcagaagcaagagcagcaccauauggaguaagauuguguggaagagaauuuauaagagcaguaauauuuacauguggaggaagcagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaggcauuuuauagaggaagaccaaguuggcaaggaacaccaggaguauuaagaggaagcagagauguauuagcaggauuaaguaguaguuguuguaaauggggauguaguaaaagugaaauaaguaguuuauguuaa

SEQ ID NO: 231 - RNA, 1410 nt, Artificial Sequence
  derived and/or modified CDS sequence (opt6) from Homo sapiens__NP_002412.1__HsMMP1
augcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaa

SEQ ID NO: 232 - RNA, 1170 nt, Artificial Sequence
  derived and/or modified CDS sequence (opt6) from Homo sapiens__NP_002412.1__HsMMP1(1-19,100-469)
augcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaa

SEQ ID NO: 233 - RNA, 3357 nt, Artificial Sequence
  derived and/or modified CDS sequence (opt6) from Clostridium histolyticum__BAA77453.1__ColG
augaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaa

SEQ ID NO: 234 - RNA, 3081 nt, Artificial Sequence
  derived and/or modified CDS sequence (opt6) from Clostridium histolyticum__BAA77453.1__HsALB(1-18)_ColG(111-1118)
augaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaa

SEQ ID NO: 235 - RNA, 3429 nt, Artificial Sequence
  derived and/or modified CDS sequence (opt6) from Clostridium histolyticum__BAA77453.1__HsALB(1-18)_ColG(1-110)_CS-F_ColG(111-1 118)
augaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaauga

SEQ ID NO: 236 - RNA, 3105 nt, Artificial Sequence
  derived and/or modified CDS sequence (opt6) from Clostridium histolyticum__BAA34542.1__ColH
augaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauag

SEQ ID NO: 237 - RNA, 3066 nt, Artificial Sequence
  derived and/or modified CDS sequence (opt6) from Clostridium histolyticum__BAA34542.1__ColH
augaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaa

SEQ ID NO: 238 - RNA, 3000 nt, Artificial Sequence
  derived and/or modified CDS sequence (opt6) from Clostridium histolyticum__BAA34542.1__HsALB(1-18)_ColH(41-1021)
augaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaa

SEQ ID NO: 239 - RNA, 3138 nt, Artificial Sequence
  derived and/or modified CDS sequence (opt6) from Clostridium histolyticum__BAA34542.1__HsALB(1-18)_ColH(1-40)_CS-F_ColH(41-102 1)
augaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagauga

SEQ ID NO: 240 - RNA, 54 nt, Artificial Sequence
  derived and/or modified CDS sequence (opt7) from Homo sapiens__NP_000468.1__signal peptide-HsALB
augaagugggugaccuucaucagccugcucuuucuguucuccagugccuacagc

SEQ ID NO: 241 - RNA, 96 nt, Artificial Sequence
  derived and/or modified CDS sequence (opt7) from Artificial__1GCM_A__isoleucinze zipper-ILZ
aggaugaagcagaucgaggacaaaauugaagagauccugagcaagauuuaccacaucgaaaacgagauugcccggaucaaaaagcucaucggcgaa

SEQ ID NO: 242 - RNA, 18 nt, Artificial Sequence
  derived and/or modified CDS sequence (opt7) from Artificial____cleavage site-Furin
aggcggcgcaggaagcgg

SEQ ID NO: 243 - RNA, 846 nt, Artificial Sequence
  derived and/or modified CDS sequence (opt7) from Homo sapiens__NP_003801.1__HsTNFSF10
auggccaugauggaggugcagggcgggcccagccugggucaaaccugcguccucaucgugauuuucacuguacuguugcagucccuguguguggcagucaccuacguguauuuuacgaacgaacucaagcagaugcaggacaaauacaguaagagcggcaucgccugcuuccugaaagaggaugacuccuauugggauccaaaugacgaagagaguaugaacagcccguguuggcaagugaaguggcaguugaggcagcugguccggaaaaugauucuccgcacuuccgaagagaccaucagcaccgugcaggagaagcaacagaauauuaguccccugguaagggaacgggggccacagcgcguggcggcccacaucacuggcaccaggggucgguccaacacgcugagcucccccaauagcaagaacgagaaagcacucgggcgcaagaucaauaguugggaauccagcagguccggccauaguuuucugagcaacuugcaucugcggaauggcgagcucgucauucacgagaaaggguucuacuauaucuacucccagacuuauuuucgcuuccaagaagagauuaaggaaaacaccaaaaaugauaagcagauggugcaguacaucuacaaauauacuagcuacccagaccccauucugcugaugaagagugccaggaacuccugcuggagcaaggaugcagaguaugguuuguacaguaucuaucaaggcgggauuuuugaacucaaagagaaugaccggaucuucguguccgucaccaacgagcaccugaucgauauggaccaugaagccagcuuuuucggcgcguuucugguggguuga

SEQ ID NO: 244 - RNA, 564 nt, Artificial Sequence
  derived and/or modified CDS sequence (opt7) from Homo sapiens__NP_003801.1__HsTNFSF10(95-281)
accagcgaggaaacuaucuccaccgugcaggagaagcaacagaacauuaguccccuggucagggaacggggcccacagcgcguggccgcacacaucacggggacuaggggucggagcaauacccucuccaguccgaacagcaaaaaugagaaggcccugggccgcaaaauuaacuccugggaaagcuccaggagugggcauagcuucuuguccaaucugcaccuccggaacggcgagcugguaauccaugagaaggguuuuuacuauauuuacagccagaccuauuuccgcuuucaagaagagaucaaagaaaauacuaagaacgacaagcagauggugcaguacaucuauaaauacaccaguuaucccgauccaauuuugcugaugaaguccgcgaggaauagcugcugguccaaagacgccgaguacgggcucuacaguaucuaucagggcggcauuuucgagcugaaggaaaacgaucggaucuuugucagcgugacgaaugagcaccugauugacauggaucaugaagcauccuucuuuggggccuuccucguggguuga

SEQ ID NO: 245 - RNA, 618 nt, Artificial Sequence
  derived and/or modified CDS sequence (opt7) from Homo sapiens__NP_003801.1__HsALB(1-18)_HsTNFSF10(95-281)
augaagugggugaccuucaucagccugcucuuucuguucuccagugccuacagcacuuccgaggaaaccauuaguacgguccaggagaaacaacagaacaucagccccuuggugagggaacggggcccacagcgcguagcagcccacauuacugggaccaggggucgguccaauacccugagcuccccgaacaguaagaaugagaaagcgcucggccgcaagaucaacagcugggaauccagcaggagugggcauuccuuucugagcaauuugcaucugcggaacggcgagcucgugauucacgagaaagguuucuauuacaucuauucccagacuuacuuucgcuuccaagaagagaucaaggaaaauaccaagaacgacaaacagaugguccaguauauuuacaaguauacgaguuaccccgauccaauccugcugaugaaaagcgccaggaacuccugcuggagcaaggacgcagaguacgggcucuauaguauuuaccagggcggcaucuuugagcugaaagaaaaugaucggauuuucguguccgugacuaaugagcacuugaucgacauggaucaugaagccagcuuuuucggggcauuucuggucgguuga

SEQ ID NO: 246 - RNA, 714 nt, Artificial Sequence
  derived and/or modified CDS sequence (opt7) from Homo sapiens__NP_003801.1__HsALB(1-18)_ILZ_HsTNFSF10(95-281)
augaagugggugaccuucaucagccugcucuuucuguucuccagugccuacagcaggaugaaacagauugaggacaagaucgaagagauuuuguccaaaaucuaucacauugaaaacgagaucgcacggaucaagaaacugauuggcgaaaccagugaggagacuaucagcacgguccaagaaaagcagcagaauauuaguccccucgugcgcgagagggggccacagcggguagccgcgcauaucacugguacccgcggcaggagcaacacccuguccaguccgaauagcaagaacgaaaaagccuuggggcggaagauuaauuccugggagagcagucgcuccggccacagcuuucuguccaaccuccaucugaggaauggugagcuggugauccacgaaaaaggguucuacuauauuuacagucaaacuuauuuucgguuccaggaggaaaucaaggagaacaccaaaaaugauaagcagaugguccaguacaucuauaaauacacgagcuaccccgacccaauucuccugaugaaguccgcacgcaacagcugcuggaguaaggaugccgaauauggcuuguacuccaucuaucaaggcgggauuuuugagcugaaagagaaugacaggaucuucgugagcgugacuaacgaacaucucauugauauggaccacgaggcauccuuuuucggugccuuucuggucggcuga

SEQ ID NO: 247 - RNA, 1077 nt, Artificial Sequence
  derived and/or modified CDS sequence (opt7) from Rattus norvegicus__NP_036656.1__RnCebpa
auggagagcgccgacuucuacgaagcagagcccaggccaccgauguccagucaucugcagagcccaccccacgcccccuccaacgcggccuuuggcuucccccgcggggcaggucccgccccaccgcccgcaccacccgccgcgccagaaccccucggcgggaucugcgagcacgaaaccaguauugauaucagcgccuauauugacccggcagccuuuaaugaugaguuccuggccgacuuguuucaacauucccggcagcaggagaaggcaaaagccgcggccggccccgccggugggggcggcgauuucgacuacccaggggcccccgcagguccaggcggggccgugaugagcgccggcgcgcacggucccccaccgggguauggcugugcagccgccggcuaccuggaugggaggcucgaaccccuguaugagcgggucggugcaccagccuugcgcccccuggugaucaagcaggaaccaagggaggaggacgaagcgaaacaacucgcccuggcaggccuguuucccuaccagccgccaccacccccacccccaccgcauccccacgccuccccagcacaccucgccgcaccccaucugcaguuccagauugcacacugcgggcaaacuaccaugcauuugcagccaggccaccccacgccgccacccacuccaguacccaguccgcaccccgccccagcgaugggugccgcaggccugcccgggccaggcgggagccucaagggucuggccggcccccauccagaucugcggaccgggggcgguggcgggggcggggccggcgcagguaaagcgaagaaguccguggacaaaaacagcaaugaguaucgcgucaggcgggaacgcaacaauaucgccgugaggaagagucgggauaaagcaaagcagcgcaacguggagacccagcaaaaagucuuggaacucacuuccgacaaugauaggcugcggaagcgcguggagcagcugagcagggagcucgacacccugcgggggaucuuucgccaguugccggaauccagucugguaaaagccaugggcaacugugccuga

SEQ ID NO: 248 - RNA, 1035 nt, Artificial Sequence
  derived and/or modified CDS sequence (opt7) from Rattus norvegicus__NP_036656.1__RnCebpa(15-344)
augagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacccagcccccgcaaugggugccgcgggccugccggggcccggcgggagucucaagggucuggccggcccacaucccgaccugaggaccgggggcgguggcgggggcggggcaggcgccgguaaagccaaaaagagcguggauaagaacuccaaugaguaccggguccgcagggagcggaacaauaucgcagugcgcaagagcagggacaaagcgaagcagcggaacguggaaacccagcaaaaagucuuggagcucacuuccgauaaugaccgccugaggaagcggguggaacagcugucccgcgagcucgauacccugagggggaucuuccggcaguugccagaaagcucccugguaaaagccaugggcaacugugcauga

SEQ ID NO: 249 - RNA, 1080 nt, Artificial Sequence
  derived and/or modified CDS sequence (opt7) from Mus musculus__NP_031704.2 __MmCebpa
auggagagcgccgacuucuacgaaguggagcccaggccaccgauguccagucaucugcagagcccaccccacgcacccuccaacgccgcguuuggcuucccccgcggggccggucccgcaccaccgcccgccccacccgcagccccagaaccccucggcgggaucugcgagcacgaaaccaguauugauaucagcgcguauauugacccggccgcauuuaaugaugaguuccuggccgacuuguuucaacauucccggcagcaggagaaggccaaagcagccgcgggccccgccggugggggcggcgauuucgacuacccaggggcacccgccgguccaggcggggcagucaugagcgccggcgcccacggucccccaccgggguauggcugugcggcagccggcuaccuggaugggaggcucgaaccccuguaugagcgggugggugccccagcauugcgcccccugguaaucaagcaggaaccaagggaggaggacgaagccaaacaacucgcgcuggccggccuguuucccuaccagccgccaccacccccacccccaccgcauccccacgcauccccagcccaccucgcagcaccccaucugcaguuccagauugcccacugcgggcaaacuaccaugcauuugcagccaggccaccccacgccgccacccacuccagugcccaguccgcacgccgcccccgcgcugggugccgcaggccucccagggcccggcagcgcccugaaggggcuggccggugcacauccagauuugcggaccggcgggggcgguggcggguccggcgcgggggccggcaaagcaaagaaaagcgucgacaagaacaguaaugaguaucgcgugaggcgggaacgcaacaauaucgccgugaggaagucccgggauaaagccaagcagcgcaacgucgagacccagcaaaaagugcucgaacugacuagcgacaaugauaggcugcggaagcgcguagagcagcucuccagggagcuggacaccuugcgggguaucuuucgccagcugcccgaaaguagccucgugaaagcaauggggaacugugccuga

SEQ ID NO: 250 - RNA, 1038 nt, Artificial Sequence
  derived and/or modified CDS sequence (opt7) from Mus musculus__NP_031704.2 __MmCebpa(15-359)
augagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacgccgcaccagcccugggugcggccggccuccccgggccgggcuccgcacugaaggggcuggccggugcccaucccgacuugaggaccggcgggggcgguggcgggagcggcgcaggggcgggcaaagccaagaaguccguggauaaaaacagcaaugaguaccggguccgcagggagcggaacaauaucgcagugcgcaagaguagggacaaagccaagcagcggaacguggaaacccagcaaaaaguccucgagcugacuuccgauaaugaccgccugaggaagcggguggaacagcucagccgcgagcuggauaccuugagggguaucuuccggcagcugccagaauccagucucguaaaagccauggggaacugugcauga

SEQ ID NO: 251 - RNA, 1077 nt, Artificial Sequence
  derived and/or modified CDS sequence (opt7) from Homo sapiens__NP_004355.2__HsCEBPA
auggagagcgccgacuucuacgaagcagagcccaggccaccgauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcauga

SEQ ID NO: 252 - RNA, 1035 nt, Artificial Sequence
  derived and/or modified CDS sequence (opt7) from Homo sapiens__NP_004355.2__HsCEBPA(15-358)
auguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcauga

SEQ ID NO: 253 - RNA, 1425 nt, Artificial Sequence
  derived and/or modified CDS sequence (opt7) from Homo sapiens__NP_000448.3__HsHNF4A
augaggcugagcaagacccucguggacauggauauggccgacuacuccgcagcccuggaucccgcguauacuaccuuggaguucgaaaacguccaggugcugacgaugggcaaugacacuagcccaagcgaggggaccaaccucaaugccccgaacucccuggguguaagugcauugugcgccaucuguggcgaucgggcaaccgggaaacacuacggcgccagcuccugcgacgguuguaagggguuuuuccgcaggagcgugcggaaaaaucauauguauuccugccgcuuuaguaggcaaugugucguggauaaggacaaacggaaccagugccgcuacuguaggcugaagaagugcuuccgggcgggcaugaaaaaggaagccgugcagaaugagcgcgauaggauuagcacucggcgcuccagcuaugaagacaguucccuccccagcaucaacgcacugcugcaggccgagguccucuccaggcaaauuaccaguccagugagcggcaucaauggggauauucgggccaaaaagaucgcauccaucgccgacguaugugagagcaugaaagaacagcuguuggugcuggucgagugggcgaaguacauucccgccuuuugcgaacucccacuggaugaccagguggcacuguugcgcgcccacgccggugagcaucuccugcugggcgcaacgaaaaggaguaugguguucaaggacguccuccuguuggggaacgauuauaucgugccccggcacugcccagagcuggccgaaaugucccgcguaagcauuaggauccucgacgagcuggugcugccguuucaggaauugcaaauugaugacaaugaguacgcguaccucaaggcaaucauuuucuuugaucccgacgccaaaggccugagugauccagguaagaucaaacggcugaggucccagguccaggugagccucgaagacuauaucaacgaucgccaguacgacagccgggggagguucggcgagcuguugcugcuccugcccacucugcaauccauuaccuggcagaugaucgagcagauucaauuuaucaaguuguucggcauggccaaaauugauaaucuccugcaggaaaugcugcucggggguaguccaagcgacgcaccccaugcccaccacccgcugcauccccacuugaugcaggagcauaugggcacuaacgugaucgucgcgaauaccaugccaacccaccuguccaacgggcagaugugugaauggccccgcccacggggccaagccgcaacgcccgagacuccacagccgagucccccagguggcaguggguccgaacccuauaagcuccugccaggcgccguggcaaccaucguaaagccccugagcgccauuccgcagccaacuaucaccaaacaggaggugauuuga

SEQ ID NO: 254 - RNA, 630 nt, Artificial Sequence
  derived and/or modified CDS sequence (opt7) from Homo sapiens__NP_061986.1__HsFGF21
auggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguuga

SEQ ID NO: 255 - RNA, 1356 nt, Artificial Sequence
  derived and/or modified CDS sequence (opt7) from Homo sapiens__NP_078852.3__HsOGFRL1
augggcaaccugcucgggggugugagcuucagggagcccaccacugucgaagacugcgauuccaccuggcagacggacagugagccagaaccggaggaacccggcccagggggcgguagcgaggggcccggccaagaguccgaacagccagcccagcccccagagcaggcaggcgggcggccgggugccagucccgcgccagaugaagacgccgaggcagccggcgcagagcaagggggcgauagcacugaagccaccgcgaagcccaaacgcuccuuuuacgccgcaagggaccuguauaaguaccggcaccaguauccaaauuucaaagauauccgcuaccagaacgacuugagcaaucugagguuuuauaagaacaaaauucccuucaagccggaugguguguacaucgaggaaguacucuccaaguggaaaggggacuaugagaagcuggaacauaaucacaccuacauucagugguuguuuccccugcgggagcaaggccucaacuucuacgccaaagagcugacuaccuaugaaaucgaggaauuuaagaaaacgaaggaggccauucgcagguuccugcucgcauacaaaaugaugcuggaauuuuucggcaucaaguugacugauaagaccgggaauguggcccgggcggucaacuggcaggagcgcuuucagcaucugaaugagagucagcacaacuaucucaggaucacucggauucugaaaagccugggugaauugggcuacgaguccuucaagagcccacucgugaaauucauccugcaugaagcccugguggagaauaccauucccaacaucaagcaaagugcacucgaauauuuugucuacaccauucgcgacaggcgggagcgcaggaaacuguugcgguucgcccagaagcacuauacgccauccgagaauuuuaucugggggcccccacgcaaggaacagagcgagggcuccaaagcacaaaagaugaguagcccgcuggccuccagccacaacagucagacuuccaugcauaaaaaggccaaagauagcaagaauaguuccagcgcggugcaccucaacagcaagaccgcagaagacaaaaagguagcccccaaagagccaguggaggaaacugacaggcccuccccagagcccaguaacgaagccgcaaagccgcggaauaccgagaaagauagcaacgccgaaaauaugaacucccagccagagaagaccgucacuacgcccaccgagaagaaagaaagcgugagucccgagaauaacgaagaggguggcaaugacaaccaggauaaugaaaacccagggaauacuaacugucaugacgugguccuggugcaauga

SEQ ID NO: 256 - RNA, 558 nt, Artificial Sequence
  derived and/or modified CDS sequence (opt7) from Homo sapiens__NP_008842.1__HsRLN1
augcccaggcuguuccucuuucaccuguuggaguucugccugcuccugaaccaguuuagccgggccguggcagccaaguggaaagacgaugucaucaaguuguguggccgcgaacuggugagggcgcaaauugccaucugcgggauguccaccuggaguaaacggagccucucccaggaggacgcaccacagacuccgcgccccguagccgaaauugugccaaguuucaucaauaaggauaccgagacgauuaucaucaugcuggaauuuauugcaaaccugcccccagagcucaaagccgcgcugagcgagaggcagcccuccuugccagaacugcaacaguacgucccggcccucaaggacagcaaucuguccuucgaggaauuuaagaaacugauccggaaccgccagagugaggcagccgauagcaaucccuccgaguugaaguaucucggucuggacacucauagccagaaaaagaggcggccauacguggcccuguucgaaaaauguugccucauuggcuguaccaagcgcagucuggcaaaauauugcuga

SEQ ID NO: 257 - RNA, 558 nt, Artificial Sequence
  derived and/or modified CDS sequence (opt7) from Homo sapiens__NP_604390.1__HsRLN2
augcccaggcuguucuuuuuccaccuccugggcgugugcuugcugcucaaccaguuuagccgggccgucgcagacuccuggauggaggaagugaucaagcugugugggcgcgaguugguaagggcccaaauugcgaucugcgguaugaguaccuggagcaaacggucccugagucaggaagaugccccacagacuccgcgccccguggcagagauuguccccagcuucaucaauaaggacaccgaaacgauuaacaugauguccgaguuuguggccaaucucccacaggagcugaaacugacucucagcgaaaugcaaccagcacugccccaguugcagcagcaugugccaguccugaaggauuccagucuccuguucgaggaauuuaaaaagcugaucaggaaccggcaaagcgaggccgcggacuccagcccgagugaguugaaguaccucggccuggauacccacucccgcaaaaagaggcagcuguauagcgcccucgcaaauaaauguugccaugugggguguaccaagcggucccuggcccgcuucugcuga

SEQ ID NO: 258 - RNA, 429 nt, Artificial Sequence
  derived and/or modified CDS sequence (opt7) from Homo sapiens__NP_543140.1__HsRLN3
auggccagguacaugcugcuccuguugcuggcaguguggguccucaccggcgagcuguggcccggggccgaagcgcgggccgcaccauauggugugcgcuugugcggcagggaguucauccgggccguaauuuuuacuugugggggcagccgcuggaggcgguccgacauccuggcacacgaagccaugggugauaccuucccggacgcggaugccgacgaggauagucucgcaggggaacuggacgaggccaugggcagcuccgaguggcuggcccucacgaagaguccccaggcauuuuaccgcggcaggccaagcuggcaagggacucccggugugcugcggggcucccgcgaugucuuggccgggcugagcuccaguugcuguaaauggggcugcagcaaguccgaaauuagcagucucuguuga

SEQ ID NO: 259 - RNA, 1410 nt, Artificial Sequence
  derived and/or modified CDS sequence (opt7) from Homo sapiens__NP_002412.1__HsMMP1
augcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacuga

SEQ ID NO: 260 - RNA, 1170 nt, Artificial Sequence
  derived and/or modified CDS sequence (opt7) from Homo sapiens__NP_002412.1__HsMMP1(1-19,100-469)
augcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauuga

SEQ ID NO: 261 - RNA, 3357 nt, Artificial Sequence
  derived and/or modified CDS sequence (opt7) from Clostridium histolyticum__BAA77453.1__ColG
augaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaauga

SEQ ID NO: 262 - RNA, 3081 nt, Artificial Sequence
  derived and/or modified CDS sequence (opt7) from Clostridium histolyticum__BAA77453.1__HsALB(1-18)_ColG(111-1118)
augaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaaguga

SEQ ID NO: 263 - RNA, 3429 nt, Artificial Sequence
  derived and/or modified CDS sequence (opt7) from Clostridium histolyticum__BAA77453.1__HsALB(1-18)_ColG(1-110)_CS-F_ColG(111-1 118)
augaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaauga

SEQ ID NO: 264 - RNA, 3105 nt, Artificial Sequence
  derived and/or modified CDS sequence (opt7) from Clostridium histolyticum__BAA34542.1__ColH
augaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcgguga

SEQ ID NO: 265 - RNA, 3066 nt, Artificial Sequence
  derived and/or modified CDS sequence (opt7) from Clostridium histolyticum__BAA34542.1__ColH
augaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggagguga

SEQ ID NO: 266 - RNA, 3000 nt, Artificial Sequence
  derived and/or modified CDS sequence (opt7) from Clostridium histolyticum__BAA34542.1__HsALB(1-18)_ColH(41-1021)
augaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcuga

SEQ ID NO: 267 - RNA, 3138 nt, Artificial Sequence
  derived and/or modified CDS sequence (opt7) from Clostridium histolyticum__BAA34542.1__HsALB(1-18)_ColH(1-40)_CS-F_ColH(41-102 1)
augaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcuga

SEQ ID NO: 268 - RNA, 54 nt, Artificial Sequence
  derived and/or modified CDS sequence (opt8) from Homo sapiens__NP_000468.1__signal peptide-HsALB
augaaaugggucaccuucaucucccuccucuuccucuucuccucugccuacucc

SEQ ID NO: 269 - RNA, 96 nt, Artificial Sequence
  derived and/or modified CDS sequence (opt8) from Artificial__1GCM_A__isoleucinze zipper-ILZ
cgaaugaaacagauagaggacaagaucgaggaaauacucucaaaaauauaccacaucgagaacgagaucgcgcgcaucaaaaagcucauaggcgag

SEQ ID NO: 270 - RNA, 18 nt, Artificial Sequence
  derived and/or modified CDS sequence (opt8) from Artificial____cleavage site-Furin
aggaggaggaggaagagg

SEQ ID NO: 271 - RNA, 846 nt, Artificial Sequence
  derived and/or modified CDS sequence (opt8) from Homo sapiens__NP_003801.1__HsTNFSF10
auggccaugauggaaguacaaggaggccccucacucggccaaaccugcguccucaucguaaucuucaccguccuccuccaaucccucugcgucgcgguaacauacgucuacuucacaaacgaacucaaacaaaugcaagacaaauacuccaaauccggaaucgccugcuuucuaaaagaagacgacuccuacugggaccccaacgacgaagaaagcaugaacucccccuguuggcaagucaaauggcaacuccgccagcucguccgaaaaaugauacuacgcaccuccgaagaaacuaucuccaccguccaagagaaacaacaaaacaucuccccacugguccgagaacgaggcccccaacgcguagccgcccacaucacuggcacacgaggacgcuccaacacccuaucaucccccaacuccaaaaacgaaaaagcccuaggccgcaaaaucaacucaugggagucaucccgauccggccacuccuuccucuccaaccuacaccuacgcaacggagaacucgucauacacgaaaaaggauucuacuacauauauucccaaaccuacuuccgcuuccaagaggaaauaaaagaaaacaccaaaaacgacaaacaaaugguccaauacauauacaaauacacauccuaccccgaccccauacuccucaugaaauccgcccgcaacucuugcugguccaaggacgcagaauacggacucuacucaaucuaccaaggcggaauauucgaacucaaagaaaacgaccgcaucuucguaucaguaaccaacgagcaccucaucgacauggaccacgaagccuccuucuucggcgccuuccucguaggcuaa

SEQ ID NO: 272 - RNA, 564 nt, Artificial Sequence
  derived and/or modified CDS sequence (opt8) from Homo sapiens__NP_003801.1__HsTNFSF10(95-281)
acaucagaagaaaccaucuccacaguccaagaaaaacaacaaaacaucucaccccuaguacgcgaacgcggcccacaacgcguagccgcacacaucaccggcacccgcggaagauccaacacccucuccucccccaacuccaaaaacgaaaaagcccucggccgaaaaaucaacuccugggaauccagccgaucaggccacucauuccucucaaaccuacaccuccgaaacggcgaacucguaauccacgaaaaaggcuucuacuacaucuacucccaaaccuacuuccgcuuccaagaagaaauaaaagaaaacaccaaaaacgacaaacaaaugguccaauacaucuacaaauacaccuccuacccagaccccauccuacuaaugaaauccgcacgaaacuccugcuggucaaaagacgccgaauacggacucuacuccaucuaccaaggcggaaucuucgaacucaaagaaaacgaccgcaucuucgucagcguaaccaacgaacaccucaucgacauggaccacgaagccagcuucuucggagccuuccuagucggcuaa

SEQ ID NO: 273 - RNA, 618 nt, Artificial Sequence
  derived and/or modified CDS sequence (opt8) from Homo sapiens__NP_003801.1__HsALB(1-18)_HsTNFSF10(95-281)
augaaaugggucaccuucaucucccuccuauuccuauucucaucagcauacuccaccagcgaagaaaccaucuccaccguccaagaaaaacaacaaaacaucuccccacucguccgcgaacgcggcccacaacgcgucgccgcccacaucaccggaacccgcggacgauccaacacacuauccucacccaacuccaaaaacgaaaaagcccucggacgcaaaauaaacucaugggaaucaucacgcucaggacacucauuccuguccaaccuccaccuacgaaacggcgaacucgucauccacgaaaaaggauucuacuacauauacucacaaaccuacuuccgcuuccaagaagaaaucaaagaaaacaccaaaaacgacaaacaaaugguccaauacaucuacaaauacaccuccuaccccgaccccauacuacucaugaaaucagcacgaaacuccugcugguccaaggacgccgaauacggccucuacuccauauaccaaggcggcaucuucgaacucaaagaaaacgaccguaucuucguaucaguaaccaacgaacaccucaucgacauggaccacgaagccuccuucuucggagccuuccuagucggcuaa

SEQ ID NO: 274 - RNA, 714 nt, Artificial Sequence
  derived and/or modified CDS sequence (opt8) from Homo sapiens__NP_003801.1__HsALB(1-18)_ILZ_HsTNFSF10(95-281)
augaaaugggugaccuucaucucacuccuauuccuguucucgagcgcauacucgcgcaugaaacaaaucgaggacaaaaucgaagaaauacucucgaaaaucuaccacaucgagaacgaaaucgcacgcaucaaaaagcucauaggcgaaaccucggaagaaaccauaagcacgguccaagaaaagcaacaaaacauaagcccacucguacgcgagcgcggaccccagcgcguggccgcacacauaaccgggaccaggggaagauccaacacccugagcucgcccaacagcaaaaacgaaaaagcgcucgggcgaaaaaucaacagcugggaauccuccaggagcgggcacucguuccuaagcaaccuccaccucagaaacggggaauuagucauacacgagaaaggguucuacuacauauacucacaaacauacuuccgcuuccaagaagaaauaaaagagaacacgaaaaaugacaaacaaaugguccaguauauauacaaauacacaagcuauccagauccaauacuccugaugaaaagcgcgcgcaacagcuguuggucaaaagaugccgaguacggccuauacuccauauaccagggcggaaucuucgaacucaaagaaaacgaucgcaucuucgugagcguaacaaacgaacaccucauagacauggaccacgaagcgagcuucuucggagccuuccucgugggauag

SEQ ID NO: 275 - RNA, 1077 nt, Artificial Sequence
  derived and/or modified CDS sequence (opt8) from Rattus norvegicus__NP_036656.1__RnCebpa
auggaaagcgcagacuucuacgaagcagaaccccgcccccccauguccucccaccuccaaucccccccccacgccccuuccaaugcagcauucggcuucccccgcggagcaggacccgcacccccaccagccccccccgccgcccccgaaccccucggcggaauaugcgaacacgaaacauccaucgacauauccgcuuacauugaccccgccgccuucaacgacgaauuccucgcagaccucuuucaacacagccgccaacaggaaaaagcaaaagccgcagccggccccgccggcggcggaggcgacuucgacuaccccggcgccccagccggaccaggaggcgccgucauguccgcaggcgcccacggccccccccccggcuacggcugcgcugccgccggcuaccucgacggccgccucgaaccccucuacgaacgagucggagccccagcacuccgaccacucguaaucaaacaagaaccccgcgaagaagacgaagcgaaacaacuugcacucgcaggccuauuccccuaccaaccccccccaccccccccacccccccacccccacgcauccccagcccaccucgccgcaccccaccuccaauuccaaauagcccauugcggccaaaccaccaugcaccuccaaccaggccaccccaccccaccccccacacccguaccaucgccucacccagcccccgcaaugggcgccgccggccuaccuggcccaggcggcagccucaaaggacuugcaggcccacaccccgaccucagaacaggcggcggcggcggcggaggcgccggcgccggcaaagcaaaaaaaucagucgacaaaaacuccaacgaauaccgaguccgacgcgaacgcaacaacaucgccguccgcaaaucccgcgacaaagccaaacaaagaaacguagaaacacaacaaaaaguucucgaacuuacaucagacaaugacagacuucgcaaacgcgucgagcaacuaucccgcgaacucgacacccuccgagguaucuuccgacaacuccccgaauccucccucgucaaagccaugggaaacugcgccuaa

SEQ ID NO: 276 - RNA, 1035 nt, Artificial Sequence
  derived and/or modified CDS sequence (opt8) from Rattus norvegicus__NP_036656.1__RnCebpa(15-344)
auguccucccaccuccaaucccccccacacgcaccauccaacgccgccuucggcuuccccagaggcgccggccccgcccccccccccgccccccccgccgcccccgaaccccuaggcggcauaugcgaacacgaaaccuccaucgacaucucagccuacauagaccccgccgcauucaacgacgaauuccucgccgaccuuuuccaacacagccgucaacaagaaaaagccaaagccgccgccggaccagccggcggcggcggcgacuucgacuacccaggcgcccccgccggacccggcggcgccgucaugucagcaggagcccacggcccaccucccggcuacggaugcgccgcagcaggcuaccucgacggcagacuagaaccacuauacgaacgcgugggagcacccgcacuccgaccccucguaaucaaacaagaaccaagagaagaagacgaagccaaacaacucgcacucgccggccucuuccccuaccaaccacccccaccccccccacccccccacccccacgcauccccagcacaccuagccgccccccaccuucaauuccaaaucgcacacugcggccagacaacaaugcaccuccaacccggccaccccacacccccucccacccccgucccauccccccacccagcccccgcaaugggcgccgccggacuaccaggacccggcggaucccuaaaaggacucgccggcccccaccccgacuuacgcaccggcggcggcggcggcggaggcgccggggcaggcaaagccaaaaaauccgucgacaaaaacucaaacgaauacagaguacgccgagaacgaaauaacaucgccguccgaaagucacgcgacaaagcaaaacaacgaaacgucgaaacacaacaaaaaguacuagaacucaccuccgacaacgaccgacuacgaaaacgcgucgaacaacuuucacgcgaacucgacacccuccgcggaaucuuccgacaacuaccagaaucaucccuugucaaagccaugggaaauugcgccuaa

SEQ ID NO: 277 - RNA, 1080 nt, Artificial Sequence
  derived and/or modified CDS sequence (opt8) from Mus musculus__NP_031704.2 __MmCebpa
auggaauccgccgacuuuuacgaaguagaaccccgcccacccauguccucccaucugcaaucaccuccccacgcccccuccaacgccgcauucggauucccccgcggcgcaggacccgccccacccccagccccacccgcagcccccgaaccccucggcggcauuugcgaacacgaaaccuccaucgacaucucagccuacauagaccccgccgccuucaacgacgaguuccucgccgaccuuuuccaacacucccgccaacaagaaaaagccaaagcagccgccggccccgccggaggcggcggagacuucgacuaccccggcgcacccgccggacccggaggcgccgucaugucagcaggcgcccauggacccccacccggcuacggaugugcagccgccggauacuuagacggccgccuagaaccccucuacgaacgcguaggcgcccccgcccuucgcccccucguuaucaaacaagaaccccgcgaagaagacgaagccaaacaacuagcccuagccggccucuuccccuaccaacccccacccccacccccgccaccccacccccaugcaucccccgcccaccuagccgcuccccaccuacaauuccaaaucgcacacugcggccaaacaaccaugcacuuacaacccggccaccccacacccccacccacccccgucccgucaccccacgccgccccagcccuaggagccgccggccuccccggacccggcuccgcccuaaaaggacucgccggcgcccacccagaccuccgaacaggcggcggcgguggcggcuccggcgccggggcaggaaaagccaagaaauccguagacaaaaacuccaacgaauaccgcguccgacgcgaaagaaacaacaucgccguccgaaaaucccgcgacaaagcaaaacaaagaaacgucgaaacacaacaaaaaguccuagaacuaaccuccgacaacgaccgccuucguaaacgcguagaacaacuaucccgcgaacucgacacccuacgcggcaucuuccgccaacuccccgaaucaucccucguuaaagcaaugggcaacugcgcauaa

SEQ ID NO: 278 - RNA, 1038 nt, Artificial Sequence
  derived and/or modified CDS sequence (opt8) from Mus musculus__NP_031704.2 __MmCebpa(15-359)
augucaagccaccuccaaucacccccccacgcccccucuaacgccgcauucgguuucccccgaggcgccgguccagccccacccccugcgcccccagccgccccagaaccccuuggaggaaucugcgaacacgaaaccuccauagacauaucagccuacaucgaccccgccgccuucaacgaugaauuccuagccgaccucuuccaacacucacgccaacaagaaaaagcaaaagccgccgccggcccagccggcggcggaggagacuucgacuacccaggcgcacccgcaggaccgggaggagccguaauguccgcaggcgcccacggcccaccccccggauacggaugcgcagccgccggcuaccucgacggacgacuagaaccacucuacgaaagagucggcgcccccgcccuacgcccccucguaauaaaacaagaaccccgagaagaagacgaagccaaacaacucgcccucgccggacucuuccccuaccaaccgccccccccccccccccccccacacccacacgcaucaccagcccaccuagcagccccccaccuacaauuccaaauagcccacugcggacaaaccaccaugcaccuacaaccaggccaccccaccccaccucccaccccagucccauccccacacgccgccccagcccucggcgccgccggacucccaggacccggcucagcccucaagggacuagccggagcacaccccgaccuccgaacaggcggaggaggcggcggcuccggagcuggugccggaaaagcaaaaaaauccgucgacaaaaacuccaacgaauacagaguccgccgagaacgaaacaacauagccguccgaaaaucccgagacaaagcaaaacaacgaaacgucgaaacccaacaaaaaguccuagaacuaaccucugacaacgaccgacuacgcaaacgagucgaacaacucagcagagaacucgacacccucagaggaauauuccgacaacuaccagaauccucccuagucaaagcuaugggaaacugcgccuaa

SEQ ID NO: 279 - RNA, 1077 nt, Artificial Sequence
  derived and/or modified CDS sequence (opt8) from Homo sapiens__NP_004355.2__HsCEBPA
auggaauccgccgacuucuacgaagccgaaccacgaccccccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaa

SEQ ID NO: 280 - RNA, 1035 nt, Artificial Sequence
  derived and/or modified CDS sequence (opt8) from Homo sapiens__NP_004355.2__HsCEBPA(15-358)
augucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaa

SEQ ID NO: 281 - RNA, 1425 nt, Artificial Sequence
  derived and/or modified CDS sequence (opt8) from Homo sapiens__NP_000448.3__HsHNF4A
augcgccuauccaaaacacucguagacauggauauggcagacuacuccgccgcccucgaccccgccuacacaacucuagaguucgaaaacguccaaguccucaccaugggcaacgauaccuccccauccgaaggaaccaaccucaacgccccaaacucccucggcgucucagcccuaugcgccaucugcggagaccgcgccaccgggaaacacuacggcgccucguccugugacgggugcaaagguuucuuccgccgcuccguccgcaaaaaucacauguacuccugccgauucucccgacaaugcgucguagacaaagauaaaagaaaccagugccgcuacugccgccugaagaaaugcuuccgcgcaggaaugaagaaagaagccguccaaaacgaacgcgaccgcaucucaacccgacgcuccucauaugaagacuccagccuccccucaaucaacgcacuacuacaagccgaaguccucagccgccaaauaacaucaccugucucuggcaucaacggagacaucagagcaaagaaaauugcaucaaucgcagacgucugcgaaucuaugaaagaacaacuccucguccugguugaaugggccaaauacaucccagccuucugcgaacucccccucgacgaccaagucgcacuacuccgcgcacacgccggcgaacaccuccuacucggcgccacaaaacgcuccauggucuucaaagacguccuccuccuaggcaacgacuacaucguccccagacacugccccgaacucgccgaaaugagccgagucucaauccggauacuagacgaacucguacucccauuccaagagcuucaaauagacgacaaugaauacgccuaccuuaaagcaauaauauucuucgauccagacgcuaaaggacucucugaccccggcaaaaucaaacgcuuacgaucccaaguccaagucucacuagaagacuacaucaacgaccgacaauacgacucccgcggcagauucggggaacuccuccuccuccuacccacacuccaaagcaucaccuggcaaaugaucgaacaaauccaauucauaaaacucuucggaauggccaaaaucgacaaccuccuacaagaaaugcuacucggcggcucccccuccgacgcaccccacgcccaucacccccuccacccacaccucaugcaagaacacaugggcaccaacguaauagucgccaacaccaugccaacccaccuaucaaacggucaaaugugcgaauggccuagaccccguggccaagccgccacgcccgaaacaccacagcccuccccacccggcggcuccggcucagaacccuacaaacuacuacccggagccgucgccacaaucguaaaaccccuaucggccaucccccaacccaccaucaccaaacaagaagucaucuaa

SEQ ID NO: 282 - RNA, 630 nt, Artificial Sequence
  derived and/or modified CDS sequence (opt8) from Homo sapiens__NP_061986.1__HsFGF21
auggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaa

SEQ ID NO: 283 - RNA, 1356 nt, Artificial Sequence
  derived and/or modified CDS sequence (opt8) from Homo sapiens__NP_078852.3__HsOGFRL1
augggcaaccuacucggcggcgucucguuccgcgaaccaaccaccguagaggacugcgacagcaccuggcaaaccgacuccgaaccugaacccgaagaacccggccccggcggcggcagcgaaggccccggccaagaaucggaacaacccgcccaacccccagaacaagccggcggacgacccggcgccucacccgccccagacgaagacgcagaagccgccggggccgagcaaggcggcgacucuaccgaagccacagcuaaaccaaaacggagcuucuacgccgcccgcgaccucuacaaauaccgccaccaauaccccaacuucaaagacauccgcuaccaaaacgaccuauccaaucuucgcuuuuauaaaaacaaaauaccuuucaaacccgacggcgucuacaucgaagaaguucuaagcaaauggaaaggcgacuacgaaaaacucgaacacaaccacaccuacauccaauggcuauucccgcuacgcgaacaaggccugaacuucuaugccaaagaacuaaccaccuacgaaauagaagaguucaaaaaaaccaaagaagcaauacgccgcuuccuccuagccuacaaaaugaugcucgaauuuuucgggaucaaacuaaccgacaaaaccggcaacgucgcccgcgcuguaaauuggcaagaacgauuccaacaccuaaacgagucccagcacaacuaccuaagaaucacccgaauacucaaaucccucggagagcucggcuacgaauccuucaaauccccacucgucaaguucauccuccacgaggcccucgucgagaacaccauccccaacaucaaacaguccgcacuagaauacuucguguacaccauccgcgaccgccgugaacgacgcaaacuccuacgcuucgcccaaaaacacuacacacccuccgaaaacuucaucuggggcccacccagaaaagaacaauccgaaggauccaaagcccaaaaaauguccagcccacuagccagcucccauaacucacaaacaucaaugcacaaaaaggccaaagacucaaaaaacuccuccagcgccguacaccucaacuccaaaaccgccgaagacaaaaaagucgcccccaaggaacccgucgaagaaacagaccgcccaucgccagaacccucaaacgaagccgcaaaaccccgcaacaccgagaaagacucaaaugccgaaaauaugaacucgcaacccgagaaaacagucaccacccccacagaaaaaaaagaauccgugagcccagaaaacaacgaagaaggcggcaacgacaaccaagacaacgaaaacccuggaaacaccaacugccacgacgucguacucguacaguaa

SEQ ID NO: 284 - RNA, 558 nt, Artificial Sequence
  derived and/or modified CDS sequence (opt8) from Homo sapiens__NP_008842.1__HsRLN1
augccccgccucuuccucuuccaccuccuagaauuuugccuccuccucaaccaauucucccgcgccgucgccgccaaauggaaagacgacguuauaaaacucugcggccgcgaacucguccgcgcccaaaucgccaucugcggcaugucaaccugguccaaacgcucacucucacaagaagacgccccccaaaccccccgcccagucgccgaaaucgucccaucauucaucaacaaagacacagaaaccauaaucaucaugcucgaauuuauagccaaccucccccccgaacucaaagccgcccucuccgaacgacaacccucccuccccgaacuacaacaauacgucccagcccucaaagacucaaaccucucauuugaagaauuuaaaaaacuaauccgcaaccgacaauccgaagccgccgacuccaaccccuccgaacuaaaauaccucggccuugacacccacagccaaaaaaaacgcagacccuacgucgcacucuucgaaaaaugcugccucaucggaugcaccaaacgcucccucgccaaauacugcuaa

SEQ ID NO: 285 - RNA, 558 nt, Artificial Sequence
  derived and/or modified CDS sequence (opt8) from Homo sapiens__NP_604390.1__HsRLN2
augccccgccucuucuucuuccaccuccucggcguaugccuccuccucaaccaauucucccgcgccgucgccgacuccuggauggaagaagucaucaaacucugcggacgcgaacucguccgcgcccaaaucgccauaugcggcauguccacuugguccaaacgcucccucucccaagaggacgcaccacaaaccccccgacccgucgcagaaaucgucccauccuucaucaacaaagacaccgaaacuaucaacaugaugucagaauuugucgcaaaccucccccaagaacuuaaacucacccucuccgaaaugcaacccgcccucccccaacuacaacaacacguccccguacuaaaagacuccucccuccucuuugaagaauuuaaaaaacuaauccgcaaccgccaaucagaagccgccgacagcucccccucagaacucaaauaccucggacucgacacacacucccgcaaaaaacgccaacuauacucagcacucgccaacaaaugcugccacgucggcugcaccaaacgcucacucgcccgauucugcuaa

SEQ ID NO: 286 - RNA, 429 nt, Artificial Sequence
  derived and/or modified CDS sequence (opt8) from Homo sapiens__NP_543140.1__HsRLN3
auggcgagauauauguugcuacugcucuuggccgugugggugcucacgggagagcucuggcccggggccgaggccagggccgcgcccuauggagugcgauugugcgggcgcgaguucauacgcgcgguaauauucacgugcgggggaucgcgcuggcgcaggagcgauaucuuggcccaugaagcgaugggggacacauucccggacgcagacgcggacgaggacucgcucgcgggcgagcucgaugaagcgauggggaguucggaauggcuagcgcuaacgaaaucgccccaggccuuuuacaggggcaggccaucauggcagggaacgcccgggguccugcgagggagcagggacguguuagcgggcuugagcucaagcuguugcaagugggggugcucgaaaucagaaauaagcucgcucuguuga

SEQ ID NO: 287 - RNA, 1410 nt, Artificial Sequence
  derived and/or modified CDS sequence (opt8) from Homo sapiens__NP_002412.1__HsMMP1
augcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaa

SEQ ID NO: 288 - RNA, 1170 nt, Artificial Sequence
  derived and/or modified CDS sequence (opt8) from Homo sapiens__NP_002412.1__HsMMP1(1-19,100-469)
augcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaa

SEQ ID NO: 289 - RNA, 3357 nt, Artificial Sequence
  derived and/or modified CDS sequence (opt8) from Clostridium histolyticum__BAA77453.1__ColG
augaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaa

SEQ ID NO: 290 - RNA, 3081 nt, Artificial Sequence
  derived and/or modified CDS sequence (opt8) from Clostridium histolyticum__BAA77453.1__HsALB(1-18)_ColG(111-1118)
augaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaaguga

SEQ ID NO: 291 - RNA, 3429 nt, Artificial Sequence
  derived and/or modified CDS sequence (opt8) from Clostridium histolyticum__BAA77453.1__HsALB(1-18)_ColG(1-110)_CS-F_ColG(111-1 118)
augaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauag

SEQ ID NO: 292 - RNA, 3105 nt, Artificial Sequence
  derived and/or modified CDS sequence (opt8) from Clostridium histolyticum__BAA34542.1__ColH
augaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcuga

SEQ ID NO: 293 - RNA, 3066 nt, Artificial Sequence
  derived and/or modified CDS sequence (opt8) from Clostridium histolyticum__BAA34542.1__ColH
augaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaa

SEQ ID NO: 294 - RNA, 3000 nt, Artificial Sequence
  derived and/or modified CDS sequence (opt8) from Clostridium histolyticum__BAA34542.1__HsALB(1-18)_ColH(41-1021)
augaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcuga

SEQ ID NO: 295 - RNA, 3138 nt, Artificial Sequence
  derived and/or modified CDS sequence (opt8) from Clostridium histolyticum__BAA34542.1__HsALB(1-18)_ColH(1-40)_CS-F_ColH(41-102 1)
augaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcuga

SEQ ID NO: 296 - RNA, 54 nt, Artificial Sequence
  derived and/or modified CDS sequence (opt9) from Homo sapiens__NP_000468.1__signal peptide-HsALB
augaaaugggucaccuucaucucucuccucuuccucuucuccuccgccuacucc

SEQ ID NO: 297 - RNA, 96 nt, Artificial Sequence
  derived and/or modified CDS sequence (opt9) from Artificial__1GCM_A__isoleucinze zipper-ILZ
cgcaugaaacagauagaggacaagaucgaggaaauacucucgaaaauauaccacaucgagaacgagaucgcacgcaucaaaaagcucauaggcgag

SEQ ID NO: 298 - RNA, 18 nt, Artificial Sequence
  derived and/or modified CDS sequence (opt9) from Artificial____cleavage site-Furin
aggaggaggaggaagagg

SEQ ID NO: 299 - RNA, 846 nt, Artificial Sequence
  derived and/or modified CDS sequence (opt9) from Homo sapiens__NP_003801.1__HsTNFSF10
auggccaugauggaaguccaaggcggaccaucccucggccaaaccugcguccuaaucgucaucuucaccguccuccuccaaucacucugcguagccgucaccuacguauacuucacaaacgaacuaaaacaaaugcaggacaaauacuccaaauccggcaucgccugcuuccucaaagaagacgacuccuacugggacccaaacgacgaagaauccaugaacuccccaugcuggcaagucaaauggcaacuccgccaacucguccgcaaaaugauccuccgcaccagcgaagaaaccaucagcacaguacaagaaaaacaacaaaacaucagcccccucguacgcgagagaggaccccaacgcguagcagcccacaucacaggcaccagaggccgcuccaacacccucuccucccccaacuccaaaaacgaaaaagcccucggccgcaaaaucaacuccugggaaagcucccgcucaggccacucauucuuauccaaccuacaccuccgcaacggagaacucguaauccacgaaaaaggcuucuacuacaucuacucccaaaccuacuuccgcuuccaagaagaaaucaaagaaaacacuaaaaacgacaaacagaugguccaauacaucuacaaauacaccuccuaccccgaccccauacuccucaugaaaagcgccagaaacuccugcuggagcaaagacgccgaauacggccuauacuccaucuaccaaggcggcaucuucgaacucaaagaaaacgaccgaaucuucgucuccguaaccaacgaacaccuaaucgacauggaccacgaagccuccuucuucggagcuuuccucgucggcuaa

SEQ ID NO: 300 - RNA, 564 nt, Artificial Sequence
  derived and/or modified CDS sequence (opt9) from Homo sapiens__NP_003801.1__HsTNFSF10(95-281)
accucagaagaaaccaucuccacaguccaagaaaaacaacaaaacauaagcccccucguccgcgaacgcggaccccaacgcguagccgcacacaucaccggaacccgcggccgauccaacacccucuccucacccaacuccaaaaacgaaaaagcccucggccgcaaaaucaacuccugggaaucaucccgcuccggccacuccuuccuaucaaaccuccaccuacgaaacggcgaacucgucauccacgaaaaaggcuucuacuacaucuacucccaaacauacuuccgauuccaagaagaaaucaaagaaaacaccaaaaacgacaaacaaaugguccaauacaucuacaaauacacauccuaccccgacccaauacuacucaugaaaagcgcccgcaacuccugcuggucaaaagacgccgaauacggacucuacuccaucuaccaaggcggcaucuucgaacugaaagaaaacgaccgcauauucguauccgucaccaacgaacaccucaucgacauggaccacgaagccagcuucuucggcgccuuucucgucggcuaa

SEQ ID NO: 301 - RNA, 618 nt, Artificial Sequence
  derived and/or modified CDS sequence (opt9) from Homo sapiens__NP_003801.1__HsALB(1-18)_HsTNFSF10(95-281)
augaaauggguaacauucaucucccuccuauuccuauucuccuccgccuacuccaccuccgaagaaaccauauccacaguccaagaaaaacaacaaaacauaucaccccucguacgagaacgaggcccccaacgcgucgccgcacacaucaccggcacccgcggccgcuccaacacccucuccucacccaacuccaaaaacgaaaaagcccucggccgcaaaaucaacuccugggaauccucacgauccggccacuccuuccucucaaaccuccaccuccgcaacggcgaacucgucauccacgaaaaaggcuucuacuacaucuacucacaaacauacuuucgcuuccaagaagaaaucaaagaaaacaccaaaaacgacaaacaaaugguccaauacaucuacaaauacaccucuuaccccgacccaauccuccucaugaaaucagcccgcaacuccugcugguccaaagacgccgaauacggccucuacuccauauaccaaggcggcauauucgaacuaaaagaaaacgaccgaauauucgucuccguaaccaacgaacaccucaucgacauggaccacgaagccucauucuucggagccuuucucgucggcuaa

SEQ ID NO: 302 - RNA, 714 nt, Artificial Sequence
  derived and/or modified CDS sequence (opt9) from Homo sapiens__NP_003801.1__HsALB(1-18)_ILZ_HsTNFSF10(95-281)
augaaauggguaaccuucaucucccuccucuuccucuuuuccuccgccuacucccgcaugaaacaaauagaagacaaaaucgaagaaauccucuccaaaaucuaccacaucgaaaacgaaauagcacgaaucaagaaacuaauaggagaaaccuccgaagaaaccauauccaccguccaggaaaaacaacaaaacauaagcccccucguccgcgaacgcggaccccaacgcgucgccgcccacaucaccgggacccgaggccgauccaacacccugagcucacccaacagcaaaaacgaaaaagcacuaggccgcaaaaucaacuccugggaauccuccagauccggccacuccuuccuaagcaaccuccaccucagaaacggcgaacucguaauccacgaaaaaggcuucuacuacaucuacucacaaaccuacuuccgcuuccaagaagaaaucaaagaaaacaccaaaaacgacaaacaaaugguccaauacaucuacaaauacacaagcuaccccgacccaauccuccuaaugaaaagcgcccgcaacuccugcuggucaaaagacgccgaauacggacucuacuccauauaccaaggcggcaucuucgaacucaaagaaaacgaccgcaucuucgucuccgucacaaacgaacaccucauagacauggaccacgaagccuccuucuucggagccuuccucgucggcuaa

SEQ ID NO: 303 - RNA, 1077 nt, Artificial Sequence
  derived and/or modified CDS sequence (opt9) from Rattus norvegicus__NP_036656.1__RnCebpa
auggaauccgccgacuucuacgaagccgaaccccgacccccaaugucaagucaucuccaaagcccaccccacgcacccuccaacgccgccuucggauuccccagaggcgccggacccgcacccccaccagcaccacccgcagcacccgaaccccuaggagguaucugcgaacacgaaaccucaauagacaucuccgcauacauagacccagcagccuucaacgacgaguuccuagccgaccuauuccaacacagccgacaacaagaaaaagccaaagccgcagcaggacccgcaggaggaggcggagacuucgacuacccaggcgcaccagccggaccaggaggagcaguaauguccgccggagcccacggcccaccacccggcuacgggugcgcagccgcgggcuaucuugacggccgccucgaaccccucuacgaacgaguaggcgcacccgcccucagaccccucgucauaaaacaagaaccccgugaagaagacgaagcaaaacaacucgcccucgcaggccuauuccccuaccaacccccaccuccaccacccccaccccacccccacgcaagccccgcacaccuugcagcgccccaccuccaauuccaaauagcccacugcggacaaaccaccaugcaccuccaaccaggccaccccacaccaccacccaccccaguucccucaccccaccccgccccagccaugggagccgcaggccuacccggacccggaggaucccucaaaggccuagccggcccccacccagaucuccgaacaggaggcggaggaggaggcggagccggagcaggcaaagcgaagaaauccgucgacaaaaauuccaacgaauaccgagucagacgcgaacgcaacaacauagccguccgaaaaucccgagacaaagccaaacaaagaaacguagaaacacaacaaaaaguccucgaacuaacaagcgacaacgaccgccuacgcaaacgcgucgaacaacucucccgagaacuagacacccuacgcggaaucuuucgccaacuccccgaaucaagccuaguaaaagcuaugggcaacugcgcguga

SEQ ID NO: 304 - RNA, 1035 nt, Artificial Sequence
  derived and/or modified CDS sequence (opt9) from Rattus norvegicus__NP_036656.1__RnCebpa(15-344)
augucaucccaucuccaaucacccccccacgccccauccaacgccgccuucggcuucccgcggggcgcuggacccgcaccaccccccgcaccccccgccgcacccgaaccccucggcggcaucugcgaacacgaaaccucaauagacaucuccgcauacauagacccagcugccuucaacgaugaauuccuagccgaccucuuccaacacucccgccaacaagaaaaagcaaaagcagcagccggacccgcaggcggaggaggagacuucgacuacccaggagcuccagcaggacccggcggagcagucauguccgcaggcgcacacggacccccacccggcuacggaugcgcagccgcaggcuaccucgacggccgccucgaaccccuauacgaacgcguaggagccccagcccucagaccacucgucauaaaacaagaaccccgagaagaagacgaagccaaacaacuagcccucgccggccucuucccauaccaaccaccaccucccccaccccccccacacccccacgccucaccagcccaccuagccgcaccacaccuacaauuccaaauagcccacugcggucaaacuaccaugcaccuacaacccggccacccaacaccaccaccaacacccgucccauccccccaucccgcacccgcaaugggagccgccggccuacccggccccggaggcucacucaaaggccuagccggcccccaccccgaccuaagaaccggaggcggaggcggcggcggagccggcgccggaaaagcaaaaaaguccguagacaaaaacucaaacgaauaccgagucagacgagaacgcaacaacauagccguccgcaaaucaagagacaaggcaaaacaaagaaacguugaaacccaacagaaaguacucgaacuaaccagcgacaacgaccgccuccgcaaacgcguagaacaauuaucccgugaacuagacacccuccgaggcauauuccgccaacucccagaaucgucccuagucaaagccaugggcaacugcgccuaa

SEQ ID NO: 305 - RNA, 1080 nt, Artificial Sequence
  derived and/or modified CDS sequence (opt9) from Mus musculus__NP_031704.2 __MmCebpa
auggaauccgccgacuucuacgaaguagaaccccgcccacccauguccucucaccuccaaucccccccccacgcaccauccaacgcagccuucggcuucccacgaggcgccggacccgcacccccccccgcacccccagcagcccccgaaccccuuggcggaaucugcgaacacgaaaccucaaucgacauuucagccuacauagaccccgccgcauucaacgacgaguuccuagccgaccucuuccaacacucccgccaacaagaaaaagcaaaagcagcagcaggaccagcaggcggcggaggcgauuucgacuaccccggcgcacccgcaggcccaggcggcgcagucauguccgccggugcccacggcccaccacccggcuacggcugcgccgccgccggcuaccucgacggcagacuagaaccccucuacgaacgugucggcgcccccgcccuacgaccacucgucaucaaacaagaaccucgcgaagaagacgaagcuaaacaacuagcccucgccggccuauucccauaccaacccccccccccgccaccccccccacacccacacgccucccccgcccaccucgcagcaccccaccuccaauuccaaauagcacacugcggccaaaccaccaugcacuuacaacccggacaccccaccccaccccccaccccagucccauccccccacgccgccccagcccucggcgcagccggccuccccggacccggcagcgcucucaaaggccucgccggcgcccaccccgaccuccgcaccggcggcggcgguggcggcucaggugccggcgcgggcaaagccaaaaaaagcguagacaaaaacucaaacgaauaccgcguccgacgcgaacgaaacaacaucgccguucgcaaaagccgagacaaagccaaacaacgcaacgucgaaacccaacaaaaaguacuagaacucacaucagacaacgaccgucuacgaaaacgagucgaacaacuaucacgagaacucgacacacuacgcggaaucuuccgacaacuucccgaaucaucccucguaaaagccaugggcaacugcgccuaa

SEQ ID NO: 306 - RNA, 1038 nt, Artificial Sequence
  derived and/or modified CDS sequence (opt9) from Mus musculus__NP_031704.2 __MmCebpa(15-359)
auguccagccacuuacaaucacccccccacgcccccuccaacgccgcauucggcuuccccagaggcgccggcccagcacccccuccagcccccccagccgccccagaaccccuuggcggcaucugcgagcacgaaaccucuauagacaucucggcauacaucgaccccgccgccuucaacgacgaauucuuagccgaccuauuccaacacucccgccaacaagaaaaagccaaagccgcagccggacccgccggcggcggaggcgacuucgacuaccccggagcacccgccggccccgggggcgcaguaaugucagccggcgcacacggcccccccccaggcuacggaugcgccgccgccggauaccuagacggccgacucgaaccccucuaugaacgugucggcgcccccgcccuccgaccccuagucaucaaacaagaaccccgcgaagaagacgaagcaaaacaacucgcccucgccggccucuucccauaccaacccccaccccccccaccccccccccacccacacgccucucccgcccaccuagcagcuccccaccuccaauuccaaauagcucacugcggacaaaccacgaugcaccuacaacccggacaccccacuccacccccaacacccguaccuuccccacacgcagcacccgcccucggcgcagcaggccuacccggccccggaucagcccucaaaggccucgcaggcgcccacccagaccuacgaaccggaggcggcggcggcggcuccggagcuggcgccggcaaagccaaaaaaucaguagacaaaaacuccaacgaauaccgaguccgcagagaacgaaacaacaucgcaguccgcaaaucccgcgacaaagccaaacaacgaaacguugaaacacaacaaaaaguacuagaacucaccuccgauaacgaccgacuaagaaaacgagucgaacaacucucccgcgaacucgacacccuaagaggcaucuuccgacaacuccccgaauccucccucgucaaagcaaugggaaacugcgccuaa

SEQ ID NO: 307 - RNA, 1077 nt, Artificial Sequence
  derived and/or modified CDS sequence (opt9) from Homo sapiens__NP_004355.2__HsCEBPA
auggaauccgcagacuucuacgaagccgaaccccgaccccccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaa

SEQ ID NO: 308 - RNA, 1035 nt, Artificial Sequence
  derived and/or modified CDS sequence (opt9) from Homo sapiens__NP_004355.2__HsCEBPA(15-358)
auguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaa

SEQ ID NO: 309 - RNA, 1425 nt, Artificial Sequence
  derived and/or modified CDS sequence (opt9) from Homo sapiens__NP_000448.3__HsHNF4A
augcgccuaagcaaaacccuugucgacauggacauggcagacuacucagccgcacucgaccccgcauacacaacacucgaauuugaaaacguacaaguccuaacaaugggcaacgacacaucaccaagcgaagguaccaaucuaaacgcccccaacagccugggcgucucagcucuuugcgcaaucugcggcgaccgcgcaaccgguaaacacuacggcgccuccuccugcgacggcugcaaaggauucuuccgccguuccguucgcaaaaaccacauguacuccugccgauuuagccgacaaugcgucgucgacaaagacaaaagaaaccaaugccgcuauugccgccucaaaaaaugcuuccgcgccggaaugaaaaaagaagcaguccaaaacgaacgcgaccgcaucagcacacgacgaucguccuacgaagacuccucacuacccucaaucaaugcacuccuccaagccgagguccuaucccgacaaaucaccucacccgucuccggcauaaacggcgacauucgcgccaaaaaaaucgccuccaucgccgacgucugcgaguccaugaaagagcaacuccucguccucgucgaaugggccaaauacauccccgcauucugugaacucccccucgacgaccaagucgcccuacuucgcgcccacgccggcgaacaucuccuccuaggcgccaccaagcgguccaugguauucaaagacguccuacuccucggcaacgacuacaucgucccccgacauugcccagaacucgccgaaaugucacgagucuccauccgaauacuugacgaacucguccuacccuuccaagaacuccaaaucgacgacaacgaguacgccuaccuaaaagcaaucaucuucuucgaccccgacgccaaaggacugucagacccaggcaaaaucaaacgccuacgcucccagguucaagucucccuagaagacuauaucaacgaccgccaguacgacuccagaggccgauucggagaacuccuccuacuccuaccgacccuacaauccaucaccuggcaaaugaucgaacagauccaauucaucaaacuauucggaauggccaaaaucgacaaccuacuccaagaaaugcuucucggaggcuccccauccgacgccccccacgcccaccacccucuccacccccaccucaugcaggaacacaugggcaccaacgucaucgucgcaaacacuaugccuacccaccucuccaacggacaaaugugcgaauggccacgcccacgcggccaagccgccacacccgaaaccccacaaccauccccccccggcggaagcggcagcgaaccuuacaaacuccuacccggcgccgucgccacuauagucaaaccucucuccgccaucccacagcccaccaucaccaagcaagaagucaucuaa

SEQ ID NO: 310 - RNA, 630 nt, Artificial Sequence
  derived and/or modified CDS sequence (opt9) from Homo sapiens__NP_061986.1__HsFGF21
auggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaa

SEQ ID NO: 311 - RNA, 1356 nt, Artificial Sequence
  derived and/or modified CDS sequence (opt9) from Homo sapiens__NP_078852.3__HsOGFRL1
augggcaaccuacuaggcggagucucauuccgcgaaccaaccaccguagaagacugcgacucaaccuggcaaaccgacuccgaaccagaaccggaggaacccggccccggcggagguagcgagggcccaggccaagaaagcgaacaaccagcccaaccacccgagcaagcaggaggacgccccggcgcaagccccgcacccgacgaagacgccgaagccgccggugccgaacaaggcggagacagcacagaagcaaccgcuaaacccaaacgcagcuucuacgcggcacgagaccuauacaaauaccggcaccaguacccaaacuucaaagacauccgauaccaaaacgaccucuccaaccucagauucuacaaaaacaagauccccuuuaaacccgacggagucuacaucgaagaaguauugagcaaauggaaaggcgacuacgaaaaacucgaacacaaccacacauacauacaauggcuauucccccuaagagaacaaggccugaacuucuacgcaaaagaacuaacaacauacgaaaucgaagaguucaaaaagacaaaagaagcaauccgcagauucuuacucgccuacaaaaugaugcuagaguucuucggcaucaaacuaacagacaaaacaggcaacgucgcccgagccgucaacuggcaggaacgcuuccaacaccucaacgaaucacaacacaacuaucuccggaucacccgaaucuuaaaaucacucggagaacuaggcuacgaaucguucaaaucaccccuaguuaaauucauccuccacgaagcccucguagaaaacaccauccccaacaucaaacaaagcgcgcuagaauacuucgucuacacaauccgcgaccgcagagaacgccgaaaacuacuccgcuucgcucagaaacacuacaccccaagcgaaaacuucaucuggggaccaccccgaaaagaacaauccgagggcuccaaagcccaaaagauguccagcccccucgcaucaucgcacaacagccaaaccucaaugcacaagaaagccaaagacuccaaaaacagcucaagcgccguccaccucaacagcaaaaccgcagaagacaagaaagucgccccaaaagaacccgucgaagagaccgaccgccccucacccgaacccagcaacgaagccgcaaaaccccgcaacaccgaaaaagacagcaacgccgaaaacaugaacucccaacccgagaaaaccguaacaacacccaccgaaaagaaagaaagcguauccccugaaaacaacgaagaaggaggaaacgacaaccaagacaacgaaaacccaggcaacacgaacugccacgacguaguccuaguacaauga

SEQ ID NO: 312 - RNA, 558 nt, Artificial Sequence
  derived and/or modified CDS sequence (opt9) from Homo sapiens__NP_008842.1__HsRLN1
augccccgccuauuccucuuccaccuccuagaauuuugccuccuccucaaccaauucucccgcgccgucgccgccaaauggaaagacgacgucaucaaacucugcggccgcgaacucguacgcgcccaaaucgccauaugcggcauguccaccuggucaaaacgcucccucucccaagaagacgccccccaaacaccccgaccagucgcagaaaucguccccuccuucaucaacaaagacacagaaaccaucaucaucaugcucgaauuuaucgcaaaccucccccccgaacucaaagccgcccucuccgaacgccaacccucacuccccgaacuccaacaauacguccccgcccucaaagacuccaaccuuuccuucgaagaauuuaaaaaacuaauccgaaaccgucaaucagaagccgccgacuccaaccccuccgaacucaaauaccuaggccuagacacccacucccaaaaaaaacgacgacccuacgucgcccucuucgaaaaaugcugccucaucggcugcacaaaacgcucccucgcaaaauacugcuaa

SEQ ID NO: 313 - RNA, 558 nt, Artificial Sequence
  derived and/or modified CDS sequence (opt9) from Homo sapiens__NP_604390.1__HsRLN2
augccccgccucuucuucuuccaccuccucggcgucugccuccuccuuaaccaguucucccgcgccguagccgacuccuggauggaagaagucaucaaacucugcggccgcgaacucguccgcgcacaaaucgccaucugcggaaugucaaccugguccaaacgcucacucucccaagaagacgccccccaaaccccccgcccugucgcagaaaucguccccuccuucaucaacaaagacaccgaaaccaucaacaugauguccgaauuugucgccaaccucccccaagaacucaaacucacccuaucagaaaugcaacccgcccuaccccaacuccaacagcacguacccguccucaaagacuccagccuccuauucgaagaauuuaaaaaacucauccgaaaccgacaauccgaagccgcagacucaucacccuccgaacuaaaauaucucggccucgacacccacucccgcaaaaaacgccaacucuacuccgcccucgccaacaaaugcugccacgucggcugcaccaaacgcucacucgcccgcuucugcuaa

SEQ ID NO: 314 - RNA, 429 nt, Artificial Sequence
  derived and/or modified CDS sequence (opt9) from Homo sapiens__NP_543140.1__HsRLN3
auggcgcgcuacaugcugcuauugcuccuggccgugugggugcucacgggcgagcucuggcccggggcagaggcaagggcagcgcccuauggagugcgauugugcgggcgagaguucauacgcgcggucauauucacgugcgggggaucacgauggcgcaggagcgauaucuuggcccaugaagcgaugggggacacguucccggacgcggacgcggacgaggacucgcuagcgggcgaacucgaugaagcgauggggagcucggaauggcucgcgcucacgaaaucgccacaggccuuuuacaggggcaggcccucguggcagggcacgcccggggucuugcgcgggaguagggacgugcucgcgggauugagcucgagcuguugcaagugggggugcucgaaaucggaaauaagcucgcuauguuga

SEQ ID NO: 315 - RNA, 1410 nt, Artificial Sequence
  derived and/or modified CDS sequence (opt9) from Homo sapiens__NP_002412.1__HsMMP1
augcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaa

SEQ ID NO: 316 - RNA, 1170 nt, Artificial Sequence
  derived and/or modified CDS sequence (opt9) from Homo sapiens__NP_002412.1__HsMMP1(1-19,100-469)
augcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaa

SEQ ID NO: 317 - RNA, 3357 nt, Artificial Sequence
  derived and/or modified CDS sequence (opt9) from Clostridium histolyticum__BAA77453.1__ColG
augaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauag

SEQ ID NO: 318 - RNA, 3081 nt, Artificial Sequence
  derived and/or modified CDS sequence (opt9) from Clostridium histolyticum__BAA77453.1__HsALB(1-18)_ColG(111-1118)
augaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaa

SEQ ID NO: 319 - RNA, 3429 nt, Artificial Sequence
  derived and/or modified CDS sequence (opt9) from Clostridium histolyticum__BAA77453.1__HsALB(1-18)_ColG(1-110)_CS-F_ColG(111-1 118)
augaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaa

SEQ ID NO: 320 - RNA, 3105 nt, Artificial Sequence
  derived and/or modified CDS sequence (opt9) from Clostridium histolyticum__BAA34542.1__ColH
augaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaa

SEQ ID NO: 321 - RNA, 3066 nt, Artificial Sequence
  derived and/or modified CDS sequence (opt9) from Clostridium histolyticum__BAA34542.1__ColH
augaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaa

SEQ ID NO: 322 - RNA, 3000 nt, Artificial Sequence
  derived and/or modified CDS sequence (opt9) from Clostridium histolyticum__BAA34542.1__HsALB(1-18)_ColH(41-1021)
augaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaa

SEQ ID NO: 323 - RNA, 3138 nt, Artificial Sequence
  derived and/or modified CDS sequence (opt9) from Clostridium histolyticum__BAA34542.1__HsALB(1-18)_ColH(1-40)_CS-F_ColH(41-102 1)
augaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaa

SEQ ID NO: 324 - RNA, 54 nt, Artificial Sequence
  derived and/or modified CDS sequence (opt11) from Homo sapiens__NP_000468.1__signal peptide-HsALB
augaaaugggucaccuucaucucccuccucuuccucuucuccuccgccuacucc

SEQ ID NO: 325 - RNA, 96 nt, Artificial Sequence
  derived and/or modified CDS sequence (opt11) from Artificial__1GCM_A__isoleucinze zipper-ILZ
cgcaugaaacagauagaggacaagaucgaggaaauacucucgaaaauauaccacaucgagaacgagaucgcgcgcaucaaaaagcucauaggcgag

SEQ ID NO: 326 - RNA, 18 nt, Artificial Sequence
  derived and/or modified CDS sequence (opt11) from Artificial____cleavage site-Furin
aggaggaggaggaagagg

SEQ ID NO: 327 - RNA, 846 nt, Artificial Sequence
  derived and/or modified CDS sequence (opt11) from Homo sapiens__NP_003801.1__HsTNFSF10
auggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcuaa

SEQ ID NO: 328 - RNA, 564 nt, Artificial Sequence
  derived and/or modified CDS sequence (opt11) from Homo sapiens__NP_003801.1__HsTNFSF10(95-281)
accuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcuaa

SEQ ID NO: 329 - RNA, 618 nt, Artificial Sequence
  derived and/or modified CDS sequence (opt11) from Homo sapiens__NP_003801.1__HsALB(1-18)_HsTNFSF10(95-281)
augaaaugggucaccuucaucucccuccuauuccucuucuccuccgccuacuccaccuccgaagaaaccaucuccaccguccaagaaaaacaacaaaacaucucaccccuuguccgcgaacgcggcccccaacgcguagccgcccacaucaccggcacccgcggccgcuccaacacccucuccucccccaacuccaaaaacgaaaaagcccucggccgcaaaaucaacuccugggaauccucccgcuccggccacucauuccucuccaaccuccaccuccgaaacggcgaacucgucauccaugaaaaaggcuucuacuacaucuacucccaaaccuacuuccgcuuccaagaagaaaucaaagaaaacaccaaaaacgacaaacaaaugguccaauacaucuacaaauacaccuccuaccccgacccaauccuacuaaugaaauccgcccgcaacuccugcugguccaaagacgccgaauacggacucuacuccauauaccaaggcggcaucuucgaacucaaagaaaacgaccgcaucuucgucuccgucaccaacgaacaccucaucgacauggaccacgaagccuccuucuucggcgccuuccucgucggcuaa

SEQ ID NO: 330 - RNA, 714 nt, Artificial Sequence
  derived and/or modified CDS sequence (opt11) from Homo sapiens__NP_003801.1__HsALB(1-18)_ILZ_HsTNFSF10(95-281)
augaagugggugaccuucaucucgcuccuguuccuguucucaagcgcguacucgcgcaugaaacaaaucgaagacaagaucgaggaaauacucucaaaaauauaccacaucgagaacgagaucgcgcgcauaaagaagcuaauaggcgagaccucggaagagaccauaagcacaguccaggaaaagcaacagaacauaagcccgcucgugcgcgagcgcggaccccagcgcguggccgcgcacauaaccgggacccggggccgcaguaacacccugagcucgcccaacagcaagaacgagaaagcacuagggcgaaaaaucaauagcugggaaucgagcagaagcgggcacucauuccuauccaaccuccaccucaggaacggggaacuggucauacacgagaaaggguucuacuacauauacucccaaacauacuuccgauuccaagaagaaauaaaagagaacacgaaaaacgacaagcaaaugguccaguacauauacaaauacacaagcuaccccgaccccauacucuugaugaaaagcgcacgcaacagcugcuggucgaaagacgccgaguacgggcucuacagcauauaccagggcggaaucuucgaacugaaagagaacgaccgcaucuucgugagcguaaccaacgaacaccucauagacauggaccacgaagcgagcuucuucggggccuuccuagugggcuag

SEQ ID NO: 331 - RNA, 1077 nt, Artificial Sequence
  derived and/or modified CDS sequence (opt11) from Rattus norvegicus__NP_036656.1__RnCebpa
auggaauccgcagacuucuacgaagccgaaccccgcccacccaugucaucccaccuccaaucaccaccccacgcacccucuaaugccgccuucggauucccccgcggcgccggacccgcacccccacccgcaccacccgccgcccccgaaccccucggaggaaucugcgaacacgaaaccagcaucgacaucucagccuacaucgaccccgccgcauucaacgacgaguuccucgccgaccuuuuccaacacuccagacaacaagaaaaagcaaaagccgcagccggacccgccggcggaggcggcgacuucgauuaccccggcgcccccgccggccccggcggcgcagucauguccgcaggagcccacggcccaccacccggcuacggcugcgccgccgcaggcuaccuagacggucgacuggaaccccucuacgaacgcgucggcgccccugcacuccgcccccucgucauaaaacaagaaccccgagaagaagacgaagccaaacaacucgcccucgccggccuauuccccuaccaaccacccccaccacccccacccccacacccacacgccucaccagcacaccuugccgcaccccaccuacaauuccaaaucgcccacugcggccaaacaacaaugcaccuacaaccuggccaccccaccccaccucccacacccguccccucaccccauccugcccccgccaugggagcagcaggccuacccggaccaggcggcucccuaaaaggccuagccggcccacaccccgaccuacgaacuggcggaggcggcggaggcggcgcaggcgcaggcaaagccaagaaauccgucgacaaaaacuccaacgaauaucgcguccgccgagaacgcaacaacauagccguccgcaaaucccgugacaaagccaaacaacgaaacguagaaacucaacaaaaaguccucgaacucacauccgacaacgaccgccucagaaaacgcgucgaacaacucucccgagaacucgacacccuccgcggcaucuuccgccaacuccccgaaucaucccucgucaaagcaaugggcaacugcgcauaa

SEQ ID NO: 332 - RNA, 1035 nt, Artificial Sequence
  derived and/or modified CDS sequence (opt11) from Rattus norvegicus__NP_036656.1__RnCebpa(15-344)
augucaucccaccuucaauccccaccccacgcccccuccaacgccgcauucggauucccccgaggagccggcccagcaccaccccccgccccaccagccgcccccgaaccccucggcggaauaugcgaacacgaaaccucaaucgacaucucagcguacauagacccagccgccuucaacgacgaauuccuagcggaccucuuccaacacuccagacaacaagaaaaagcaaaagccgccgccggacccgccggagguggaggagacuucgacuaccccggagcccccgccggacccggcggcgcaguaauguccgccggcgcacacggucccccccccggauacggcugcgcugccgccggcuaccuagacggcagacuagaaccacuauacgaacgcgucggcgccccagcccucagaccacuagucaucaaacaagaaccccgagaagaagacgaagcaaaacaacuagcccuagccggccuauuccccuaccaaccaccccccccaccaccccccccccacccccacgcaucccccgcccaccuagccgccccccaccuccaauuccaaauagcccacugcggccaaacaaccaugcaccuacaacccggacaccccacacccccccccacccccguccccucaccccaccccgcacccgccaugggcgccgccggccuccccggacccggcggcucccuaaaaggacuagccgguccccaccccgaccuccgcaccgggggaggaggcggcggcggcgccggagccggcaaagccaaaaaauccguugacaaaaacucaaacgaauacagagucagacgagaacgcaacaacauugccguccgcaaaucacgcgacaaagcaaaacaacgaaacgucgaaacacaacaaaaaguccucgaacucacuuccgacaacgaccgacuacgcaaacgcgucgaacaacucagccgcgaacucgacacacuccgcggcaucuuccgccaacuacccgaauccucccucguaaaagccaugggcaacugcgccuaa

SEQ ID NO: 333 - RNA, 1080 nt, Artificial Sequence
  derived and/or modified CDS sequence (opt11) from Mus musculus__NP_031704.2 __MmCebpa
auggaaucagccgacuucuacgaagucgaaccacgccccccaaugucuucccaccuacaaucuccgccccacgcucccucaaacgcagccuucggcuucccacgcggcgccggacccgcccccccacccgccccucccgccgcacccgaaccccucggcggcaucugcgaacacgaaacauccaucgacauaagcgcauacauagaccccgcagcauucaacgacgaauuccucgccgaccucuuccaacacucgcgucaacaagaaaaagcaaaagccgcagccggccccgccggcggcggcggcgacuucgacuaccccggcgcccccgccggucccggaggagccguaaugucggcaggcgcccacggacccccccccggauacggaugcgccgccgccggcuaccuagacggacgccucgaaccccucuacgaaagagucggagcacccgcccuacgcccucucguaaucaaacaagaaccccgcgaagaagacgaagccaaacaacucgcccuagccggacucuuccccuaccaacccccccccccaccacccccaccccacccccacgcaucaccagcccaccuagccgccccccaccuacaauuccaaauagcacacugcggacaaaccaccaugcaccugcaaccaggacacccaacccccccacccaccccaguccccuccccccacgccgcccccgcacucggagccgccggccuacccggccccggcucagcacucaaaggccuugcaggcgcccacccagaccuacguacaggcggaggaggcggcggcuccggcgccggcgccggaaaagccaaaaaauccgucgacaaaaacuccaacgaauaccgcguccgccgcgaacgaaacaacaucgccgucagaaaaucccgcgacaaagcaaaacaacgcaacgucgaaacccaacaaaaaguccuagaauuaaccuccgacaacgacagacuucgcaaacgagucgaacaacuaucacgcgaacucgacacacuccgcggcauauuccgccaacucccagaaucaucccuugucaaagccaugggcaacugcgccuaa

SEQ ID NO: 334 - RNA, 1038 nt, Artificial Sequence
  derived and/or modified CDS sequence (opt11) from Mus musculus__NP_031704.2 __MmCebpa(15-359)
augucaucccaccuccaauccccaccccacgccccauccaacgcugccuucggauucccccgcggcgccggccccgcacccccacccgccccccccgcugcaccagaacccuuaggcggaauaugcgaacacgaaaccagcauagacaucucagcauacauugaccccgccgccuucaacgacgaauuccucgccgaccucuuccaacacagccgacaacaagaaaaagcaaaagccgcugcaggccccgccggcggcggcggcgacuucgacuaccccggcgccccagccggcccaggcggcgccgucaugucugcaggcgcccacggccccccacccggauacggaugugccgccgccggcuaucucgacggccgccuagaaccacucuacgaaagaguaggcgcccccgcccuccgcccccucgucaucaaacaagaacccagagaagaagacgaagccaaacaacucgcacucgccggccuguuccccuaccaaccccccccacccccaccccccccccacccacacgccucaccagcccaccucgccgccccccaccuccaauuccaaauagcccacugcggccaaaccaccaugcaccuccaaccgggccaccccaccccccccccaacccccguccccucuccccacgcagccccagcauuaggcgccgccggacuaccaggcccaggaucagcccuaaaaggacuagcaggcgcacaccccgaccuccgcacaggcggaggcggaggcggcagcggagccggcgccggaaaagccaaaaaaucagucgauaaaaacucaaacgaauacagaguccgacgcgaacgcaacaacaucgccguccgcaaaucaagagacaaagcuaaacaacgcaacguggaaacucaacaaaaaguccucgaacucaccucagacaacgaccgccuccgcaaacgcgucgaacaacucuccagagaacucgacacccuccgcggaaucuuucgacaacuccccgaauccucacucguaaaagcaaugggcaauugcgccuaa

SEQ ID NO: 335 - RNA, 1077 nt, Artificial Sequence
  derived and/or modified CDS sequence (opt11) from Homo sapiens__NP_004355.2__HsCEBPA
auggaaagcgcagacuucuacgaagcagaaccccgaccccccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaa

SEQ ID NO: 336 - RNA, 1035 nt, Artificial Sequence
  derived and/or modified CDS sequence (opt11) from Homo sapiens__NP_004355.2__HsCEBPA(15-358)
augucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaa

SEQ ID NO: 337 - RNA, 1425 nt, Artificial Sequence
  derived and/or modified CDS sequence (opt11) from Homo sapiens__NP_000448.3__HsHNF4A
augcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgccuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucuag

SEQ ID NO: 338 - RNA, 630 nt, Artificial Sequence
  derived and/or modified CDS sequence (opt11) from Homo sapiens__NP_061986.1__HsFGF21
auggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaa

SEQ ID NO: 339 - RNA, 1356 nt, Artificial Sequence
  derived and/or modified CDS sequence (opt11) from Homo sapiens__NP_078852.3__HsOGFRL1
augggcaaccuccuaggcggagucucauuccgcgaacccaccacaguagaagacugcgacuccaccuggcaaacagacuccgaacccgaaccagaggaaccuggacccggcggcggaucggaaggacccggccaagaaagcgagcagcccgcacaaccacccgaacaagccgguggacgcccaggcgccucacccgccccagacgaggacgccgaagccgccggcgcagagcagggcggagacagcacugaagccacagcaaaaccuaaacgcuccuucuacgccgcccgagaccucuacaaauacagacaccaauaccccaacuucaaagacauucgauaccaaaacgaccucuccaaccuccgcuucuacaaaaacaaaaucccauucaaacccgacggagucuacauagaagaaguccucuccaaauggaaaggcgacuacgaaaaacuggaacacaaccacacauacauccaauggcucuuuccccuccgcgaacaaggccucaacuucuacgccaaagaacuaaccacauacgagaucgaagaauuuaaaaaaacuaaagaagccauacgccgcuuccuacucgccuacaaaaugaugcuagaguucuucggcaucaaacucaccgacaaaaccggcaacgucgcccgagccgucaacuggcaagaacgauuccaacaccucaacgaaucccaacacaacuaccuacgcauaacccgcauacuaaaaucccuuggcgaacucggauacgaauccuucaaauccccacuugucaaguucauccuccacgaagcucuagucgaaaacacaauaccaaacauaaaacaguccgcacucgaauacuucgucuacaccauccgcgaccgccgcgagcgccgcaaacuccuccgcuucgcccagaaacacuacacccccuccgaaaacuucaucuggggacccccaagaaaagaacaaucagaaggaucaaaagcucaaaagaugagcuccccacuagccucaucacacaacucccaaaccuccaugcacaaaaaagccaaagacucaaaaaauuccagcucagccguccaccucaacucaaaaaccgcagaggacaaaaaagucgcacccaaagaacccguagaagaaaccgaccgaccaucacccgaaccauccaacgaagcagccaaaccacgcaacacagagaaagacuccaacgccgaaaacaugaacucccaacccgaaaaaacagugaccacacccaccgaaaaaaaagaauccguaucccccgaaaacaacgaggaaggcggaaacgacaaccaagacaacgaaaaccccggcaacaccaacugccaugacgucguccuaguccaauag

SEQ ID NO: 340 - RNA, 558 nt, Artificial Sequence
  derived and/or modified CDS sequence (opt11) from Homo sapiens__NP_008842.1__HsRLN1
augccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgccccccaaaccccccgccccgucgccgagaucguccccuccuucaucaacaaagacaccgaaaccaucaucaucaugcucgaauuuaucgccaaccucccccccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugccuaaucggcugcaccaaacgcucccucgccaaauacugcuaa

SEQ ID NO: 341 - RNA, 558 nt, Artificial Sequence
  derived and/or modified CDS sequence (opt11) from Homo sapiens__NP_604390.1__HsRLN2
augccccgccucuucuucuuccaccuccucggcgucugccuccuccuaaaccaauucucccgagccgucgccgacuccuggauggaagaagucaucaaacuaugcggccgcgaacucguccgcgcccaaaucgccaucugcggcauguccaccugguccaaacgcucccucucccaagaagacgccccccaaaccccccgccccgucgccgaaaucguccccuccuucaucaauaaagacaccgaaaccauaaacaugauguccgaauuugucgcaaaccucccccaagaacucaaacucacccucuccgaaaugcaacccgcccucccccaacuacaacaacacguccccguccucaaagacuccucccuacucuucgaagaauuuaaaaaacucauccgcaaccgccaaucagaagccgccgacuccuccccauccgaacucaaauaccucggccucgacacccacucccgaaaaaaacgccaacucuacagcgcccucgccaacaaaugcugccacgucggcugcaccaaacgcucccucgcccgcuucugcuaa

SEQ ID NO: 342 - RNA, 429 nt, Artificial Sequence
  derived and/or modified CDS sequence (opt11) from Homo sapiens__NP_543140.1__HsRLN3
auggcgcgcuauauguugcuauugcucuuggccgugugggugcucacgggcgagcucuggcccggggccgaggccagggccgcgcccuauggcgugcgcuugugcgggcgcgaguucauacgagcggucauauucacgugcgggggcucgcgcuggcgcaggagcgauauauuggcccaugaagcgaugggggacacguucccggacgcggacgcggacgaggacucgcucgcgggcgagcucgaugaagcgauggggagcucggaauggcuagcgcuaacgaaaucgccccaggccuuuuacaggggcaggcccucguggcagggaacgcccgggguauugcgagggagcagggacgugcucgcgggcuugagcucaagcuguugcaagugggggugcucgaaaucggaaauaagcucgcucuguuga

SEQ ID NO: 343 - RNA, 1410 nt, Artificial Sequence
  derived and/or modified CDS sequence (opt11) from Homo sapiens__NP_002412.1__HsMMP1
augcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaa

SEQ ID NO: 344 - RNA, 1170 nt, Artificial Sequence
  derived and/or modified CDS sequence (opt11) from Homo sapiens__NP_002412.1__HsMMP1(1-19,100-469)
augcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaa

SEQ ID NO: 345 - RNA, 3357 nt, Artificial Sequence
  derived and/or modified CDS sequence (opt11) from Clostridium histolyticum__BAA77453.1__ColG
augaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 346 - RNA, 3081 nt, Artificial Sequence
  derived and/or modified CDS sequence (opt11) from Clostridium histolyticum__BAA77453.1__HsALB(1-18)_ColG(111-1118)
augaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaaguga

SEQ ID NO: 347 - RNA, 3429 nt, Artificial Sequence
  derived and/or modified CDS sequence (opt11) from Clostridium histolyticum__BAA77453.1__HsALB(1-18)_ColG(1-110)_CS-F_ColG(111-1 118)
augaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaaguga

SEQ ID NO: 348 - RNA, 3105 nt, Artificial Sequence; identical to SEQ ID NO: 96
  derived and/or modified CDS sequence (opt11) from Clostridium histolyticum__BAA34542.1__ColH

SEQ ID NO: 349 - RNA, 3066 nt, Artificial Sequence
  derived and/or modified CDS sequence (opt11) from Clostridium histolyticum__BAA34542.1__ColH
augaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 350 - RNA, 3000 nt, Artificial Sequence
  derived and/or modified CDS sequence (opt11) from Clostridium histolyticum__BAA34542.1__HsALB(1-18)_ColH(41-1021)
augaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccgguga

SEQ ID NO: 351 - RNA, 3138 nt, Artificial Sequence
  derived and/or modified CDS sequence (opt11) from Clostridium histolyticum__BAA34542.1__HsALB(1-18)_ColH(1-40)_CS-F_ColH(41-102 1)
augaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgauga

SEQ ID NO: 352 - RNA, 54 nt, Artificial Sequence; identical to SEQ ID NO: 212
  derived and/or modified CDS sequence (opt12) from Homo sapiens__NP_000468.1__signal peptide-HsALB

SEQ ID NO: 353 - RNA, 96 nt, Artificial Sequence; identical to SEQ ID NO: 213
  derived and/or modified CDS sequence (opt12) from Artificial__1GCM_A__isoleucinze zipper-ILZ

SEQ ID NO: 354 - RNA, 18 nt, Artificial Sequence
  derived and/or modified CDS sequence (opt12) from Artificial____cleavage site-Furin
aggagaagaaggaaaaga

SEQ ID NO: 355 - RNA, 846 nt, Artificial Sequence
  derived and/or modified CDS sequence (opt12) from Homo sapiens__NP_003801.1__HsTNFSF10
auggcaaugauggaaguacaaggaggacccagccuaggacaaacaugcguacuaauaguaauauucacaguacuacuacaaucacuuugcguugcaguaacauacguauacuucacaaacgaacuaaaacaaaugcaagacaaauacucaaaaucaggaauagcaugcuucuuaaaagaagaugacucuuacugggacccaaacgacgaagaaagcaugaauagccccugcuggcaaguaaaauggcaacuaagacaacucguacgaaaaaugauacuacgaacaucagaagaaacaauaucaacaguacaagaaaaacaacaaaacauauccccauuaguaagagaaagaggaccacaaagaguagcagcacacauaacaggaacaagaggaagaucaaacacacuaucaaguccaaacaguaaaaacgaaaaagcacuaggaagaaaaauaaacagcugggaaaguaguagaucaggacacucauuccuaucaaaccuacaccuaagaaacggagaauuaguaauccaugaaaaaggauucuacuacauauacucacaaacauauuucagauuccaagaagaaauaaaagaaaauacuaaaaacgacaaacaaaugguccaauauauauacaaauauacaucauacccagacccaauacuacuaaugaaaucagcaagaaacucaugcuggucaaaagaugcagaauauggacuauacucaauauaccaaggaggaauauucgaacuaaaagaaaaugacagaauauuuguaucaguaacaaacgaacaccuaauagacauggaccacgaagcaucauuuuucggcgccuuccuaguaggauaa

SEQ ID NO: 356 - RNA, 564 nt, Artificial Sequence
  derived and/or modified CDS sequence (opt12) from Homo sapiens__NP_003801.1__HsTNFSF10(95-281)
acaucagaagaaacaauaagcacaguacaagaaaaacaacaaaacauaucaccacuuguaagagaaagaggaccacaaagaguagcagcacacauaacaggaacaagaggaagaucaaacacacuaagcucaccaaacucaaaaaacgaaaaagcacuaggaagaaaaauaaacucaugggaaucaagcagaucaggacacucauuccuaucaaaccuacaccuaagaaacggagaacuuguaauacacgaaaaaggauucuacuacauauacucacaaacauacuucagauuccaagaagaaauaaaagaaaacacaaaaaacgacaaacaaaugguacaauacauauacaaauacacaucauacccagacccaauacuacuaaugaaaagcgcaagaaacagcuguuggucaaaagaugcagaauacggacuauacucaauauaccaaggaggaaucuucgaauuaaaagaaaacgacagaauauucguaucaguaacaaacgaacaccuaauagacauggaccacgaagcaucauucuucggagcauuccuaguaggauaa

SEQ ID NO: 357 - RNA, 618 nt, Artificial Sequence
  derived and/or modified CDS sequence (opt12) from Homo sapiens__NP_003801.1__HsALB(1-18)_HsTNFSF10(95-281)
augaaauggguaacauucauaucacuacuauuccuauucucaagcgcauacucaacaucagaagaaacaauaucaacaguacaagaaaaacaacaaaacauaucaccauuaguaagagaaagaggaccacaaagaguagcagcacacauaacaggaacaagaggaagaagcaacacacuaagcucaccaaacaguaaaaacgaaaaagcacuaggaagaaaaauaaacucaugggaaucaucaagaucaggacacucauuccuaucaaaccuacaccuaagaaacggagaauuaguaauacacgaaaaaggauucuacuauauauacucacaaacauacuucagauuccaagaagaaauaaaagaaaacaccaaaaacgacaaacaaaugguacaauacauauacaaauacacaucauacccagacccaauacuacuaaugaaaagcgcaagaaacucaugcuggucaaaagacgcagaauacggacuauacagcauauaccaaggaggaauauucgaacuaaaagaaaacgacagaauauucguaucagucacaaacgaacacuuaauagacauggaccacgaagcaucauucuucggagcauucuuaguaggauaa

SEQ ID NO: 358 - RNA, 714 nt, Artificial Sequence
  derived and/or modified CDS sequence (opt12) from Homo sapiens__NP_003801.1__HsALB(1-18)_ILZ_HsTNFSF10(95-281)
augaaauggguaacauucauaucgcuacuauucuuauucucaagcgcauacucaagaaugaaacaaauagaagacaaaauagaagaaauacucucaaaaauauaccauaucgaaaacgaaauagcaagaauaaaaaaacuaauaggcgaaacuucagaagaaacaauaagcacaguacaagaaaaacaacaaaacauaagcccacuuguaagagaaagaggaccacaaagaguagcagcacauauaacaggaacaagaggaagaagcaacacacuaagcucaccaaacaguaaaaacgaaaaagcacuuggacgaaaaauaaauagcugggaaucaucaagaagcggacacucguuccuaagcaaccuacaccuaagaaacggagaacuuguaauacacgaaaaaggauucuacuacauauacucacaaacauauuuuagauuccaagaagaaauaaaagaaaacacaaaaaacgacaaacaaaugguacaauacauauacaaauacacaucauacccagacccaauacuccuaaugaaaagcgcaagaaacagcugcuggucaaaagaugcagaauacggacuauacagcauauaccaaggaggaauauuugaacuaaaagaaaacgauagaauauucguaaguguaacaaacgaacaccuaauagacauggaccacgaagcuagcuucuucggagcauuccuaguaggauaa

SEQ ID NO: 359 - RNA, 1077 nt, Artificial Sequence
  derived and/or modified CDS sequence (opt12) from Rattus norvegicus__NP_036656.1__RnCebpa
auggaaucagcagacuuuuaugaagcugaaccaagaccccccaugucaucccacuuacaaucacccccacaugcuccaucaaacgcagcauuuggauucccaaggggagcaggcccugcaccaccaccagcaccaccagcagcaccagaaccauuaggagguauuugugaacacgaaacaucaauagacauauccgcuuauauagauccagcagcauuuaaugaugaauuucuagcagaucuuuuucaacauaguagacaacaagaaaaagcaaaagcagcagcugguccagcuggaggaggaggagacuucgauuauccaggagcaccugcagggccuggaggagcggucaugagugcaggugcacauggaccaccuccaggauauggaugugcagcagccggauauuuagauggaagacuagaaccauuauaugaaagaguaggcgcaccagcauuaagaccauuaguaauaaaacaagaaccaagagaagaagacgaagcaaaacaauuagcacuagcaggacuauucccauaucaaccuccaccuccaccaccaccaccacacccacaugcaucaccagcacauuuagcagcaccacauuuacaauuucaaauugcacauuguggacaaacaacaaugcauuuacaaccaggacauccaacaccaccaccaacaccaguaccuucaccacauccagcaccagcaaugggcgcagcagguuuaccaggaccaggaggaaguuuaaaaggcuuagcugguccucauccagaccuaagaaccggaggaggaggaggaggaggagcaggagcaggaaaagcaaaaaaaaguguagauaaaaauucaaaugaauauagaguaagaagagaaagaaacaauauagcaguaagaaaaucuagagauaaagcgaaacaaagaaauguagaaacacaacaaaaaguguuagaacuaacaucagacaacgauagauuaagaaaaagaguagaacaauuaucgagagaacuugauacccuacgaggaauauuucgacaauuaccugaaucaucauuaguaaaagcaauggguaauugcgcauaa

SEQ ID NO: 360 - RNA, 1035 nt, Artificial Sequence
  derived and/or modified CDS sequence (opt12) from Rattus norvegicus__NP_036656.1__RnCebpa(15-344)
augucaucacaucuacaaucaccaccucaugcaccuucaaaugcagccuuuggauucccaagaggagcaggaccagcaccaccaccagcaccaccagcagcaccagaaccauuaggaggaauaugcgaacaugaaacaucaaucgauauauccgcauauauagauccagcagcauucaaugaugaauuuuuagcagauuuauuucaacauagucgacaacaagaaaaagcaaaagcagcagcaggcccagcaggcggcggaggagacuuugauuacccuggagcaccagcuggacccggaggagcaguaaugucagcaggagcacaugguccaccaccaggauauggaugcgcagcagcaggauacuuagauggaagacuagaaccauuauaugaaagaguaggagcaccugcauuaagaccauuaguuaucaaacaagaaccaagagaagaagaugaagcaaaacaauuagcauuagcaggacuauuuccauaucaaccaccaccaccaccaccaccaccacauccacaugcaucaccagcucaucuagcagcaccucauuuacaauuucaaauagcacauuguggucaaacaacaaugcaucuacaaccaggacauccaacaccaccaccaacuccaguuccaucaccacauccagcaccagcaaugggagcagcaggacuaccaggaccaggaggaucauuaaaaggacuagcaggaccacauccugaucuaaggacaggcggcggaggaggaggaggugcaggagcuggaaaagcuaaaaaaucaguagauaaaaauucaaacgaauauagaguaagacgcgaaagaaauaauauugcgguacgaaaaucaagagauaaagcaaaacaacgaaauguagaaacacaacaaaaaguacuagaauuaacaagugauaacgaccgucuaagaaaaagaguagaacaacuaucaagagaauuagauacucuaagagguaucuuuagacaacuaccagaaucaucauuaguuaaagcaaugggaaacugcgcauaa

SEQ ID NO: 361 - RNA, 1080 nt, Artificial Sequence
  derived and/or modified CDS sequence (opt12) from Mus musculus__NP_031704.2 __MmCebpa
auggaaucagcagacuuuuaugaaguagaaccuagaccaccaaugaguucacauuuacaaucaccaccacaugcuccaucaaaugcagccuuuggauuuccuagaggagcaggaccagcaccaccaccagcuccaccagcugcaccagaaccauuaggaggaauaugugaacaugaaacaucaauagauauaucagcauacauagacccagcugcauuuaaugacgaauuucuagcugaucuuuuccaacacucaagacaacaagaaaaagcaaaagcagcagcuggaccagcaggaggaggaggagauuuugauuauccuggagcaccagcaggaccuggaggagcaguaaugucagcuggugcacauggaccuccaccaggauacgguugugcagcagcaggcuacuuagacggacgauuagaaccauuauacgaaagaguaggcgcuccagcacuuagaccuuuagucauuaaacaggaaccaagagaagaagaugaagcaaaacaacuagcuuuagcaggacuauuuccauaucaaccacccccaccaccaccaccuccacacccacaugcaucaccugcacaucuagcugcaccacauuuacaauuccaaauagcacauuguggucaaacaaccaugcauuuacaacccggacauccaaccccaccuccaacacccguuccuucuccacaugcagcaccagcacuaggagcagcagguuuaccaggacccggaagugcauuaaaaggauuagcaggagcacauccagauuuaagaacuggcgguggugguggaggaaguggagcuggugcaggaaaagccaaaaaaucaguagauaaaaauucuaacgaauauagaguaagaagagaaagaaauaauauugcuguaagaaaaucaagagauaaagccaaacaaagaaauguagaaacacaacaaaaaguauuagaauuaacaagcgauaaugauagguuaagaaaaagaguagaacaacugucuagagaauuagauacauuaagaggaauauuuagacaacuaccagaauccucacuaguaaaagcaaugggcaauugcgcuuaa

SEQ ID NO: 362 - RNA, 1038 nt, Artificial Sequence
  derived and/or modified CDS sequence (opt12) from Mus musculus__NP_031704.2 __MmCebpa(15-359)
augaguagccacuuacaaucaccaccacaugcaccaucaaaugccgcauuuggauucccacgaggugcagguccagcaccaccuccagcaccaccagcagcaccagaaccauuaggaggaauuugugaacaugaaacaucaauagauauuucagcauauauagauccugcagcauuuaaugaugaauuuuuagcagauuuauuucaacauaguagacaacaagaaaaagcaaaagcagcugcuggcccagcaggaggaggcggagauuucgauuauccuggagcaccagcaggaccuggaggagcaguaaugagugcaggugcacacggaccacccccaggauauggaugugcagcagcaggauacuuagaugguagauuagaaccauuauaugaaaggguaggugcaccagcacuaagaccauuaguaauaaaacaagaaccaagagaagaagacgaagcaaaacaauuagcauuagcuggauuauuucccuaccaaccacccccaccaccaccuccaccacacccacaugcuucaccagcucauuuagcagcaccucauuuacaauuucaaauagcucauugcggacaaacaacaaugcaucuacaaccaggacauccaacaccaccuccaacaccaguaccaucaccucaugcugcaccagcacuaggugcagcuggauuacccggaccaggaucagcauuaaaaggauuagcaggagcucauccagauuuaagaacagguggaggagguggugguucuggagcaggagcagguaaagcaaaaaaaaguguagauaaaaauaguaacgaauacagaguaagaagagaacgaaauaauauagcaguuagaaaaucaagagauaaagcaaaacaaagaaauguagaaacacaacaaaaaguccuagaauuaacaucagauaaugacagauuaagaaaaagaguagaacaauuaucacgagaacuugauacauuaagaggaauauuuagacaauuaccugaauccucucuaguaaaagcaaugggaaauugcgcauaa

SEQ ID NO: 363 - RNA, 1077 nt, Artificial Sequence
  derived and/or modified CDS sequence (opt12) from Homo sapiens__NP_004355.2__HsCEBPA
auggaaagcgcugauuuuuaugaagcagaaccaagaccaccaaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaa

SEQ ID NO: 364 - RNA, 1035 nt, Artificial Sequence
  derived and/or modified CDS sequence (opt12) from Homo sapiens__NP_004355.2__HsCEBPA(15-358)
augagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaa

SEQ ID NO: 365 - RNA, 1425 nt, Artificial Sequence
  derived and/or modified CDS sequence (opt12) from Homo sapiens__NP_000448.3__HsHNF4A
augagacuaucaaaaacauuagucgacauggauauggcagacuacuccgcugcauuagauccagcauacacaacacuugaauuugaaaacguacaaguacuaacgaugggaaacgacaccucaccaagcgaaggaaccaauuuaaacgcacccaauucauuaggaguuucagcauuaugcgcaauaugcggagauagagcaacagggaaacauuauggagccucaaguugcgacggauguaaagguuucuucagaagaucaguaagaaaaaaccacauguacucaugcagauuuucuagacaaugcguaguagacaaagauaaacgaaaucaaugcagauauuguagauuaaaaaaauguuucagagcaggaaugaaaaaagaagcuguccaaaaugaacgagaucgaauaagcacacgacgauccucauaugaagauucaucacuaccauccauaaacgcauuacuacaagcagaagucuuaucaagacaaauaacaucaccaguaucaggaaucaacggagauauaagagcaaaaaaaauugcaucaauagcagauguaugcgaaucaaugaaagaacaauuacuuguccuuguagaaugggccaaauacauaccagcauuuugugaacuaccacuagacgaucaaguagcauuauuaagagcacacgccggagaacacuuauuacucggagcaacaaaaagauccaugguauuuaaagacguacuuuuacuaggcaaugauuacauaguaccucgucacuguccagaacuagcagaaaugucacgaguaucaauaagaauccuagaugaacuuguacuaccauuccaagaauuacaaauagacgacaacgaauacgcauaccucaaagcuauaauauucuuugacccagacgcaaaaggcuuaucugauccaggaaaaaucaaaagauuaagaucacaaguacaaguaucauuagaagacuacauaaacgauagacaauacgauucaagaggcagauuuggagaacuauuauuacuacuacccacacuacaaucuauaacauggcaaaugauugagcaaauacaguuuauaaaacuauucggaauggcaaaaauagacaaccuauuacaagaaaugcuacuaggaggcucaccaagugaugccccccacgcacaccauccacuccacccacaccucaugcaagaacacaugggaacaaauguuauaguagcaaacacuaugccaacccacuuaucuaauggacaaaugugcgaauggccaagaccacguggucaagcagcgacaccugaaacaccacaaccaaguccaccaggcgguucaggaucagaacccuauaaauuauuacccggagccguagcaacaauaguaaaaccacuaucugcuauaccacaaccaacaauaacaaaacaagaaguaauauaa

SEQ ID NO: 366 - RNA, 630 nt, Artificial Sequence
  derived and/or modified CDS sequence (opt12) from Homo sapiens__NP_061986.1__HsFGF21
auggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaa

SEQ ID NO: 367 - RNA, 1356 nt, Artificial Sequence
  derived and/or modified CDS sequence (opt12) from Homo sapiens__NP_078852.3__HsOGFRL1
augggaaacuuauuaggaggaguaucauuccgagaaccuacgaccguugaagacugcgacucaacauggcaaacagacucugaaccagaaccagaagaaccuggaccaggcggaggaagcgaaggcccaggacaagaauccgaacaaccagcacaaccaccagaacaagcaggaggaagaccuggagcaucgcccgccccagaugaagacgcagaagccgcaggagcagaacaaggaggcgacuccacagaagccacagcaaaaccaaaacgaucauucuacgcugcacgcgaucuauacaaauauagacaccaauauccaaacuucaaagauauaagauaccaaaaugacuuaagcaacuuacgguucuacaaaaacaaaaucccauuuaaaccagacggaguauacauagaagaaguacuaucaaaauggaaaggagacuacgaaaaacuagaacacaaccacacauacauacaaugguuauucccuuuaagagaacaaggacucaauuucuaugcaaaagaacuaaccacauacgaaauugaagaauuuaaaaaaacaaaagaagcaaucagaagauucuuacuagcauacaaaaugaugcuagaauuuuuuggaauaaaacucacagacaaaacaggaaacguagccagagcaguuaacuggcaagaacgcuuucaacaucuaaacgaaucacaacacaacuaucucagaauaacaagaauacuaaaaucacugggagaauuaggcuacgaaucauuuaaaucaccacuuguaaaauucauauuacacgaagcacucguagaaaacacaauaccaaauauaaaacaaucugcccucgaauauuuugucuacaccaucagagauagacgcgaaagaagaaaauuauuacgauucgcacaaaaacauuacacaccaucagaaaacuucauauggggaccaccaagaaaagaacaauccgaaggaaguaaagcacaaaaaaugucaucaccacuagcauccucacacaacagucaaacaagcaugcacaaaaaagcaaaagacagcaaaaacucaucaagugcaguacaccuaaacucaaaaacagcagaagauaaaaaaguagcuccuaaagaaccgguugaagaaacagaucgaccaucaccagaaccaagcaacgaagcagcaaaaccuagaaacacagaaaaagacucaaaugcagaaaacaugaauagccaaccugaaaaaacaguaaccacaccaacagaaaaaaaagaaaguguaaguccagaaaacaaugaagaaggagguaacgacaaucaagauaacgaaaacccaggcaauaccaacugucaugacguaguucuaguacaauaa

SEQ ID NO: 368 - RNA, 558 nt, Artificial Sequence
  derived and/or modified CDS sequence (opt12) from Homo sapiens__NP_008842.1__HsRLN1
augccaagacuauucuuauuccacuuacuagaauuuugccuacuacuaaaccaauucucaagagcagucgcagcaaaauggaaagacgacguaauaaaacuaugcggaagagaacuuguaagagcacaaauagcaauaugcggaauguccacauggucaaaaagaucacuaucacaagaagacgcaccacaaacaccaagaccaguagcagaaauaguaccuagcuucauaaacaaagacacagaaacaauaauaauaauguuagaauuuauagccaaccuaccacccgaacuaaaagcagcauuaagcgaaagacaaccaucauuaccagaauuacaacaauacguaccagcacuaaaagacucaaaccuaucauucgaagaauuuaaaaaauuaauaagaaacagacaaucagaagcagcagauucaaacccaucagaacuaaaauaccuaggacuagacacacacucacaaaaaaaaagaagaccauacguagcacuauucgaaaaaugcugccuaauaggaugcacaaaacgaucauuagcaaaauacugcuaa

SEQ ID NO: 369 - RNA, 558 nt, Artificial Sequence
  derived and/or modified CDS sequence (opt12) from Homo sapiens__NP_604390.1__HsRLN2
augccaagacuauucuucuuccacuuacuaggaguaugcuuacuacuaaaccaauucucaagagcaguagcagacucauggauggaagaaguaauaaaacuaugcggcagagaacuuguaagagcacaaauagcaauaugcggaaugucaaccuggucaaaaagaucacuaucacaagaagacgcaccacaaacaccacgaccaguagcagaaauaguaccaucauucauaaacaaagacacagaaacaauaaacaugaugucagaauuuguagcaaacuuaccccaagaacuaaaauuaacauuaucagaaaugcaaccagcacuaccacaacuacaacaacacguaccaguacuaaaagacucaucacuacuauucgaagaauuuaaaaaacuaauaagaaacagacaaucagaagcagcagacucaucaccaucagaauuaaaauaccuaggacuagacacacacagcagaaaaaaacgacaacuauacagcgcacuagcaaacaaaugcugccacguaggaugcacaaaaagaucacuagcaagauucugcuaa

SEQ ID NO: 370 - RNA, 429 nt, Artificial Sequence
  derived and/or modified CDS sequence (opt12) from Homo sapiens__NP_543140.1__HsRLN3
auggcaagguauauguuauuauuauuacuagcaguauggguauuaacaggagaauuauggccaggagcagaagcaagagcagcaccauauggagugagauuauguggaagagaauuuauaagagcaguaauauuuacauguggaggaaguagauggagaagaagugauauauuagcacaugaagcaaugggagauacauuuccagaugcagaugcagaugaagauucauuagcaggagaauuagaugaagcaaugggaaguagugaaugguuagcauuaacaaaaagcccacaagcauuuuauagaggaagaccaaguuggcaaggaacaccaggaguauuaagaggaaguagagauguauuagcaggauuaaguaguaguuguuguaaauggggauguaguaaaagugaaauaaguaguuuauguuaa

SEQ ID NO: 371 - RNA, 1410 nt, Artificial Sequence
  derived and/or modified CDS sequence (opt12) from Homo sapiens__NP_002412.1__HsMMP1
augcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaa

SEQ ID NO: 372 - RNA, 1170 nt, Artificial Sequence
  derived and/or modified CDS sequence (opt12) from Homo sapiens__NP_002412.1__HsMMP1(1-19,100-469)
augcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaa

SEQ ID NO: 373 - RNA, 3357 nt, Artificial Sequence
  derived and/or modified CDS sequence (opt12) from Clostridium histolyticum__BAA77453.1__ColG
augaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaauga

SEQ ID NO: 374 - RNA, 3081 nt, Artificial Sequence
  derived and/or modified CDS sequence (opt12) from Clostridium histolyticum__BAA77453.1__HsALB(1-18)_ColG(111-1118)
augaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaauga

SEQ ID NO: 375 - RNA, 3429 nt, Artificial Sequence
  derived and/or modified CDS sequence (opt12) from Clostridium histolyticum__BAA77453.1__HsALB(1-18)_ColG(1-110)_CS-F_ColG(111-1 118)
augaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaa

SEQ ID NO: 376 - RNA, 3105 nt, Artificial Sequence
  derived and/or modified CDS sequence (opt12) from Clostridium histolyticum__BAA34542.1__ColH
augaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaa

SEQ ID NO: 377 - RNA, 3066 nt, Artificial Sequence
  derived and/or modified CDS sequence (opt12) from Clostridium histolyticum__BAA34542.1__ColH
augaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaa

SEQ ID NO: 378 - RNA, 3000 nt, Artificial Sequence
  derived and/or modified CDS sequence (opt12) from Clostridium histolyticum__BAA34542.1__HsALB(1-18)_ColH(41-1021)
augaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaa

SEQ ID NO: 379 - RNA, 3138 nt, Artificial Sequence
  derived and/or modified CDS sequence (opt12) from Clostridium histolyticum__BAA34542.1__HsALB(1-18)_ColH(1-40)_CS-F_ColH(41-102 1)
augaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaa

SEQ ID NO: 380 - RNA, 54 nt, Artificial Sequence; identical to SEQ ID NO: 212
  derived and/or modified CDS sequence (opt13) from Homo sapiens__NP_000468.1__signal peptide-HsALB

SEQ ID NO: 381 - RNA, 96 nt, Artificial Sequence; identical to SEQ ID NO: 213
  derived and/or modified CDS sequence (opt13) from Artificial__1GCM_A__isoleucinze zipper-ILZ

SEQ ID NO: 382 - RNA, 18 nt, Artificial Sequence
  derived and/or modified CDS sequence (opt13) from Artificial____cleavage site-Furin
agaagaaggaggaagaga

SEQ ID NO: 383 - RNA, 846 nt, Artificial Sequence
  derived and/or modified CDS sequence (opt13) from Homo sapiens__NP_003801.1__HsTNFSF10
auggcaaugauggaaguccaaggaggacccucacuaggacaaacaugcguacuaauaguaauauucacaguacuacuacaaucacuaugcguagcaguaacauacgucuacuuuacaaacgaacuuaaacaaaugcaagauaaauacucaaaaucaggaauagcaugcuucuuaaaagaagaugacucauacugggacccaaacgacgaagaaucaaugaauagcccaugcuggcaaguaaaauggcaacuaagacaacuuguaagaaaaaugauacuaagaacaucagaagaaacaauaucaacaguacaagaaaaacaacaaaacauaucaccauuaguaagagaaagaggcccacaacgcguagcagcacacauaacaggaacaagaggaagaucaaacacacuaucaucaccaaauucaaaaaaugaaaaagcauuaggacgaaaaaucaacucaugggaaucaucaagaucaggacauucauucuuaaguaaucuacacuuacgaaacggagaauuaguaauacacgaaaaaggauucuacuacauauacucacaaacauacuucagauuccaagaagaaauaaaagaaaacacaaaaaacgacaaacaaaugguacaauacauauauaaauauacaagcuacccagacccaauauuauuaaugaaaagugcaagaaauagcugcuggucaaaagacgcagaauauggacuauacucaauauaccaaggaggaauauucgaacuaaaagaaaacgaccgaauauucguaucaguaacaaacgaacaccuaauagacauggaccacgaagcaucauucuucggagcauuccucgucggauaa

SEQ ID NO: 384 - RNA, 564 nt, Artificial Sequence
  derived and/or modified CDS sequence (opt13) from Homo sapiens__NP_003801.1__HsTNFSF10(95-281)
acaucagaagaaacaauaucaacaguacaagaaaaacaacaaaacauaucaccccuaguaagagaaagaggaccacaacgaguagcagcacacauaacaggaacaagaggacgaucaaacacacuaucaucaccaaacuccaaaaacgaaaaagcacuaggaagaaaaauaaacucaugggaaucaucaagaagcggacacucauuucuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaucuuacccagacccaauacuacuaaugaaaucagcaagaaacagcugcuggucaaaagacgcagaauacggacuauacucaauauaccaagguggaauauucgaacuaaaagaaaacgacagaauauucguaucaguaacaaacgaacacuuaauagacauggaccacgaagcaucauucuucggagcauucuuaguaggauaa

SEQ ID NO: 385 - RNA, 618 nt, Artificial Sequence
  derived and/or modified CDS sequence (opt13) from Homo sapiens__NP_003801.1__HsALB(1-18)_HsTNFSF10(95-281)
augaaauggguaacauucauaucacuacuauuccuauucucaucagcauacucaacaucagaagaaacaauaagcacaguacaagaaaaacaacaaaacauaucaccacucguaagagaaagaggaccacaaagaguagcagcacacauaacaggaacaagaggacgaucaaacacacuaucaucaccaaacagcaaaaacgaaaaagcacuaggaagaaaaaucaauucaugggaauccucaagaucaggacacucauuccuauccaaccuacaccuaagaaacggagaauuagucauacacgaaaaaggauucuacuacauauacucacaaacauacuucagauuccaagaagaaauaaaagaaaacaccaaaaacgacaaacaaaugguacaauacauauacaaauacacaucauacccagacccaauacuacuaaugaaaucagcaagaaacaguugcuggucaaaagacgcagaauacggacuauacucaauauaccaaggaggaauauucgaacuaaaagaaaacgacagaauauucguaucaguaacaaacgaacaccuaauagauauggaccacgaagcaucauucuucggagccuuccuaguaggauaa

SEQ ID NO: 386 - RNA, 714 nt, Artificial Sequence
  derived and/or modified CDS sequence (opt13) from Homo sapiens__NP_003801.1__HsALB(1-18)_ILZ_HsTNFSF10(95-281)
augaaauggguaacauuuauaucacuauuauuccuauucucaagcgcauacucaagaaugaaacaaauagaagacaaaauagaagaaauacuaucaaaaauauaccacauagaaaacgaaauagcacgaauaaaaaaacuaauaggagaaacaucagaagaaaccauaagcacaguacaagaaaaacaacaaaacauaagcccacuuguaagagaaagaggaccacaaagaguagcagcacacauaacaggaacaagaggaagauccaacacauuaucauccccaaacucaaaaaacgaaaaagcacuaggacgaaaaauaaacagcugggaaucaagcagaucaggacacucauuccuaagcaaccuacaccuaagaaacggagaauuaguaauacacgaaaaaggauucuacuacauauacucccaaacauacuuccgauuccaagaagaaauaaaagaaaacacaaaaaacgacaaacaaaugguacaauacauauacaaauacaccucauacccagacccaauacuacuaaugaaaagcgcaagaaacucaugcuggucaaaagacgcagaauacggacuauacucaauauaccaaggaggaauauucgaauuaaaagaaaacgaucgaauauucguaagcguaacaaacgaacaccuaauagacauggaccaugaagcaucauucuucggagcauuccucguaggcuaa

SEQ ID NO: 387 - RNA, 1077 nt, Artificial Sequence
  derived and/or modified CDS sequence (opt13) from Rattus norvegicus__NP_036656.1__RnCebpa
auggaaagugcggauuuuuacgaagcagaaccaagaccaccaauguccucucaucuucaaucaccaccucaugcuccaucaaaugcugcauuugguuuuccaagaggagcuggaccagcaccuccaccagcaccucccgcagcaccagaacccuuaggagguauaugcgaacaugaaacaucaauagauauaucagcauacauagauccugcagcauucaaugaugaauuuuuagcagauuuauuucaacauucaagacaacaagaaaaagcuaaagcagcugcaggaccagcagguggaggaggagauuuugacuauccaggugcaccagcaggccccggaggcgcaguaaugagcgccggagcccauggaccaccaccaggauacgguugugcugcagcaggcuauuuagacggaagacuagaaccauuauaugaacgaguaggagcuccagcauuaagaccauuaguaauuaaacaagaaccaagagaagaagaugaagcaaaacaacuagcauuagcaggacuauuuccauaucaaccacccccaccuccaccaccaccacacccacacgcauccccagcacacuuagcagcaccacauuuacaauuucaaauagcacauuguggacaaacaacuaugcauuuacaaccaggacauccaacaccaccaccaacaccuguuccuucaccacacccagcaccagcaaugggagcagcaggauuaccaggaccaggaggaucauuaaaaggauuagcuggaccacauccagaucucagaacaggaggaggaggaggaggaggagcaggagcuggaaaagcaaaaaaaucaguagauaaaaacucaaaugaauauagaguaagaagggaaagaaauaacauagcaguaagaaaaaguagagauaaagcaaaacaaagaaauguagaaacacaacaaaaaguauuagaauuaaccucagauaaugaucgauuaagaaaaagaguagaacaauuaucaagagaauuagauacauuaagagguauuuuuagacaauuaccagaaucuucacuaguaaaagcaaugggaaacugcgcuuaa

SEQ ID NO: 388 - RNA, 1035 nt, Artificial Sequence
  derived and/or modified CDS sequence (opt13) from Rattus norvegicus__NP_036656.1__RnCebpa(15-344)
augucaagccaucuacaaaguccaccacaugcaccaucaaaugccgcauuuggguuuccaagaggagcaggaccagcaccaccaccagcaccaccagccgcuccagaaccauuaggaggaauaugugagcaugaaacaucaauagauauaucagcauauauagauccagcagcauuuaaugaugaauuucuugcagauuuauuucaacauucacgacaacaagaaaaagccaaagcagcagcaggaccagcaggaggaggcggagauuuugauuauccuggagcaccagcaggaccaggaggcgcaguaauguccgcaggagcacacggaccaccaccaggauauggaugugcagcugcaggauauuuagauggacgucuugaaccauuauaugaacgagucggagcuccagcacuaagaccacuaguaauaaaacaagaaccaagagaagaagaugaagcuaaacaacuugcacuagcaggacuauucccauaucaaccaccaccuccaccaccaccaccacacccacaugcaaguccagcccauuuagcagcaccacauuuacaauuucaaauagcccacuguggacaaacaacuaugcauuuacaaccaggacauccuacaccaccaccgacaccuguaccaucaccucauccugcaccagcuaugggagcagcaggauuaccaggaccaggaggaucacuaaaaggauuagcaggaccucauccagaucuaagaacaggagguggagggggaggaggagcaggagcagggaaagcaaaaaaaucaguagauaaaaacucaaaugaauauagaguaagaagagaaagaaauaauauagcaguaagaaaaaguagagauaaagcaaaacaacgaaauguagaaacacaacaaaaaguacuagaauuaacaagcgauaaugacagauuaagaaaaagaguagaacaauuaucaagagaauuagauacacuacgaggaaucuuuagacaacuaccagaaaguaguuuaguuaaagcuaugggaaauugugcauaa

SEQ ID NO: 389 - RNA, 1080 nt, Artificial Sequence
  derived and/or modified CDS sequence (opt13) from Mus musculus__NP_031704.2 __MmCebpa
auggaaucagcagauuuuuaugaaguugaaccuagaccaccaaugagcucacaucuacaaucaccaccacacgcaccuucuaacgcugcauuuggauuuccacgaggagcaggccccgcaccuccaccagcaccaccagcugcaccagaaccucuuggaggaauaugcgaacacgaaacaaguauagauaucucagcauauauagacccagcagcauucaaugaugaauuuuuagcagacuuauuucaacauucaagacaacaagaaaaagcaaaagcagcagcaggaccagcaggaggaggaggagacuucgauuauccuggagcucccgcagguccuggcggagcaguaaugucagccggagcacauggaccaccuccaggauauggaugugcagcagcuggauauuuagacggaagguuagaaccacuauaugaaagaguaggagcaccagcauuacgaccacuaguuauaaaacaagaaccuagagaagaagacgaagcaaaacaacuagcacuagcagguuuauuuccauaccaaccuccaccaccucccccaccaccucacccacaugcaucaccagcacacuuagcggcaccacauuuacaauuucaaauagcacauuguggacaaacaacaaugcauuuacaaccuggacauccaacaccaccaccaacaccgguaccaucaccucaugcagcaccagcacucggagcagcaggucuaccaggaccaggaucagcuuuaaaaggauuagcaggagcacauccagauuuaagaacagguggagguggaggaggaaguggugcaggagcaggcaaagcaaaaaaaucagucgauaaaaacuccaacgaauacagaguaagaagagaaagaaacaauauagcagugagaaaaaguagagacaaagcaaaacaacgaaauguagaaacacaacaaaaaguauuagaguuaacaucagauaaugaucgauuaagaaaaagaguugaacaauuaucaagagaacuagauacacuaagaggaauauuuagacaauuaccagaaucaucauuaguaaaagcaaugggaaacugcgcauaa

SEQ ID NO: 390 - RNA, 1038 nt, Artificial Sequence
  derived and/or modified CDS sequence (opt13) from Mus musculus__NP_031704.2 __MmCebpa(15-359)
augagcagucaucuacaaucaccaccacaugcaccuucaaaugcagcauuuggauuuccacgaggagcagguccagcacccccaccagcaccaccagcagcaccugaaccucuagguggaaucugugaacaugaaacaaguauagauaucucagcauauauagauccagcagcauuuaaugaugaauuuuuagcugaucuuuuucaacacucaaggcaacaagaaaaagcaaaagcagcagccggaccagcaggaggaggaggagauuuugauuaucccggagcaccagcaggaccaggcggagcaguaaugucagcuggugcacaugguccgccaccuggauaugggugugcagcagcaggauauuuagauggaagauuagaaccacuauaugaaagagucggugcaccagcauuaagaccccuaguaauaaaacaagaaccaagagaagaagacgaagcaaaacaacuagcauuagcaggccuauuuccauaucaaccaccaccaccaccacccccaccacauccacaugcaucaccagcacaucuagcagcuccacauuuacaauuccaaauagcucauuguggacaaacaacaaugcaucuacaaccuggacacccaacaccaccaccaacuccaguaccaucaccacacgcagcaccagcacuaggagcagcaggccuaccaggaccaggaagugcuuuaaaaggauuagcuggugcacauccagauuuaagaacaggagguggcggaggaggaaguggugcaggagcaggcaaagcaaagaaaagcguagauaaaaauucuaaugaauauagaguaagaagagaaaggaauaauauagcaguacgaaaaucuagagauaaagcaaaacaacgaaauguagaaacacaacaaaaaguucuagaauuaacaucagauaacgauagacuaagaaaaagagucgaacaauuaucaagggaauuagacacauuaagaggcauauucagacaacuuccagaaucaucauuagucaaagcaaugggaaauugugcauga

SEQ ID NO: 391 - RNA, 1077 nt, Artificial Sequence
  derived and/or modified CDS sequence (opt13) from Homo sapiens__NP_004355.2__HsCEBPA
auggaaucugcagauuuuuaugaagcagaaccaagaccaccuauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaa

SEQ ID NO: 392 - RNA, 1035 nt, Artificial Sequence
  derived and/or modified CDS sequence (opt13) from Homo sapiens__NP_004355.2__HsCEBPA(15-358)
auguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaa

SEQ ID NO: 393 - RNA, 1425 nt, Artificial Sequence
  derived and/or modified CDS sequence (opt13) from Homo sapiens__NP_000448.3__HsHNF4A
augagacuaaguaaaacauuaguagacauggacauggccgacuauagugccgcauuagauccagcuuauacaacacuagaauuugaaaacguccaaguauuaacaaugggaaaugacacaucaccaagugaaggcaccaaucuaaaugcaccaaacucacuagguguaucagcccucugcgcaauaugcggagacagagcaacagggaaacacuacggagcaucuucaugugacggauguaaaggcuucuuuagaagaucaguaagaaaaaaccacauguacaguugcagauucagcagacaauguguagucgacaaagauaaaagaaaucaaugcagauauugcagacuaaaaaaauguuuccgagcaggaaugaaaaaagaagcaguacaaaacgaaagagaucguaucucaacaagaagaucaucauacgaagacucaagucuaccaagcauaaacgcacuucuucaagcagaaguacuaagcagacaaauaacaagcccgguaucagguaucaacggagacauaagggcaaaaaaaauagcgucaauagcagacguaugcgaaaguaugaaagaacaauuacuuguccuuguagaaugggcaaaauacauaccugcauuuugcgaauuaccacuagacgaccaaguagcacuauuaagagcacaugcaggagaacaccuucuacuaggagcuacuaaaagaucaaugguauuuaaagacguacuauuacuaggaaaugauuacauaguaccaagacacugcccagaacuugcagaaaugucacgaguaagcauaagaauccuagaugaacuugucuuaccauuccaagaauuacaaauagacgacaacgaauacgcauaucuaaaagcaauaauauuuuucgacccagacgcaaaaggacuaucagauccaggcaaaauuaaacgacuccgaucacaaguucaaguaucucuagaagacuauauaaacgaucgacaauacgauagucgaggacgauucggugaauuauuacuucuuuuaccaacauuacaaucaauaacguggcaaaugauugaacaaauccaauucauaaaauuauucggaauggcaaaaauagacaaucuauuacaagaaaugcuacuuggaggaagcccaucagacgcuccacacgcccaccacccucuacauccacaccuaaugcaagaacacaugggcacuaacguaauaguagcaaacacaaugcccacccaucuaucaaacggacaaaugugcgaauggccaagacccagaggacaagcugcaacaccagaaacaccacaaccaaguccaccaggagguaguggaagugaaccauacaaacuuuuaccaggagcaguagcaacaauaguaaaaccacuaucagcaauuccccaaccaacaauaacaaaacaagaaguaauauaa

SEQ ID NO: 394 - RNA, 630 nt, Artificial Sequence
  derived and/or modified CDS sequence (opt13) from Homo sapiens__NP_061986.1__HsFGF21
auggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaa

SEQ ID NO: 395 - RNA, 1356 nt, Artificial Sequence
  derived and/or modified CDS sequence (opt13) from Homo sapiens__NP_078852.3__HsOGFRL1
augggaaaccuacucggcggaguuucauucagagaaccaacaacaguagaagacugcgauaguacauggcagaccgauucagaaccugaaccagaagaaccaggccccgguggaggaagcgaaggcccuggacaagaaucagaacaaccagcacaaccaccagaacaagcaggaggaagaccaggagcaagcccagcaccagacgaagacgcagaagcagcaggagccgaacaaggaggagauagcacugaagcaacagcaaaaccaaaaagaucuuuuuacgcagcacgagacuuauauaaauauagacaccaauacccaaauuucaaagacauaagauaccaaaaugaccuauccaaccuacgcuucuacaaaaauaaaauuccauucaaaccagauggaguauacauagaagaaguacuaagcaaauggaaaggugacuaugaaaaacuagaacauaaccacaccuacauacaauggcuauuuccccuaagagaacaaggauuaaauuucuacgcaaaagaacuuacaaccuacgaaauagaagaauuuaaaaaaaccaaagaagccauaagaagauucuuauuagcauacaagaugauguuagaauuuuucggaauuaaacucacagacaaaacaggcaacguagcacgagccguaaacuggcaagaacgauuccaacacuuaaacgaaagucagcacaacuaccuaagaauaacaagaauauuaaaaaguuuaggagaacuaggcuacgaaucauucaaaucuccacuuguaaaauucauacuacacgaagccuuagucgaaaacacaauaccaaacauaaaacaaucugcacuagaauacuuuguauacacaauaagagacagaagagaaaggagaaaauuacuacgauucgcucaaaaacacuauacaccaucagaaaauuucauauggggccccccaagaaaagaacaaagcgaaggcucaaaagcacaaaaaaugucaaguccacuagcaucaagccauaacucacaaacuucaaugcacaaaaaagccaaagacucaaagaacucaucaucagccguacaccuaaacagcaaaacagcagaagauaaaaaaguugcaccaaaagaaccaguagaagaaacagauagaccaucaccagaaccaucaaacgaagcggcaaaaccaagaaacacugagaaagauagcaacgcagaaaacaugaacagccaaccagaaaaaacaguaacgacaccaacugaaaaaaaagaaucaguaaguccagaaaauaaugaagaaggcggcaacgauaaccaagacaacgaaaauccaggaaauaccaacugccacgacguaguauuaguacaauaa

SEQ ID NO: 396 - RNA, 558 nt, Artificial Sequence
  derived and/or modified CDS sequence (opt13) from Homo sapiens__NP_008842.1__HsRLN1
augccaagacuauucuuauuccaccuacuagaauuuugcuuacuacuaaaccaauucucaagagcaguagcagcaaaauggaaagacgacguaauaaaacuaugcggaagagaacuuguaagagcacaaauagcaauaugcggaaugucaacauggucaaaaagaucacuaucacaagaagacgccccacaaacaccaagaccaguagcagaaauaguaccaucauucauaaacaaagacacagaaacaauaauaauaaugcuagaauuuauagcaaaccuaccaccagaauuaaaagcagcauuaucagaaagacaaccaucauuaccagaacuacaacaauacguaccagcacuaaaagacucaaaccuaucauucgaagaauuuaaaaaacuaauaagaaacagacaaucagaagcagcagacucaaacccaucagaacuaaaauaccuaggacuagacacacacucacaaaaaaaacgaagaccauacguagcacuauuugaaaaaugcugcuuaauaggaugcacaaaaagaucacuagcaaaauacugcuaa

SEQ ID NO: 397 - RNA, 558 nt, Artificial Sequence
  derived and/or modified CDS sequence (opt13) from Homo sapiens__NP_604390.1__HsRLN2
augccaagacuauucuuuuuccaccuacuaggcguaugccuccuacuaaaccaauuuucaagagcaguagcagacucauggauggaagaaguaauaaaacuaugcggaagagaacuuguaagagcacaaauagcaauaugcggaaugucaacauggucaaaaagaucauuaucacaagaagacgcaccacaaacaccaagaccaguagcagaaauaguaccaucauucauaaacaaagacacagaaacaaucaauaugaugucagaauuuguagcaaaccucccacaagaacuaaaacuaacacuaucagaaaugcaaccagcacuaccacaauuacaacaacacgucccaguacucaaagacucaucacuauuauucgaagaauuuaaaaaauuaauaagaaacagacaaucagaagcagcagacagcucacccucagaacuaaaauaccuaggacuagacacacacucaagaaaaaaaagacaacuauacucagcacuagccaacaaaugcugccacguaggaugcacaaaaagaucacuagcaagauucugcuaa

SEQ ID NO: 398 - RNA, 429 nt, Artificial Sequence
  derived and/or modified CDS sequence (opt13) from Homo sapiens__NP_543140.1__HsRLN3
auggcaagauauauguuauuauuauuauuagcaguauggguauuaacaggagaauuauggccaggagcagaagcaagagcagcaccauauggaguaagauuauguggaagagaauuuauaagagcaguaauauuuacauguggaggaaguagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaagcauuuuauagaggaagaccaaguuggcaaggaacaccaggaguauuaagaggaaguagagauguauuagcaggauuaaguucaaguuguuguaaauggggauguucaaaaucagaaauaaguucauuauguuaa

SEQ ID NO: 399 - RNA, 1410 nt, Artificial Sequence
  derived and/or modified CDS sequence (opt13) from Homo sapiens__NP_002412.1__HsMMP1
augcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaa

SEQ ID NO: 400 - RNA, 1170 nt, Artificial Sequence
  derived and/or modified CDS sequence (opt13) from Homo sapiens__NP_002412.1__HsMMP1(1-19,100-469)
augcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaa

SEQ ID NO: 401 - RNA, 3357 nt, Artificial Sequence
  derived and/or modified CDS sequence (opt13) from Clostridium histolyticum__BAA77453.1__ColG
augaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaa

SEQ ID NO: 402 - RNA, 3081 nt, Artificial Sequence
  derived and/or modified CDS sequence (opt13) from Clostridium histolyticum__BAA77453.1__HsALB(1-18)_ColG(111-1118)
augaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaa

SEQ ID NO: 403 - RNA, 3429 nt, Artificial Sequence
  derived and/or modified CDS sequence (opt13) from Clostridium histolyticum__BAA77453.1__HsALB(1-18)_ColG(1-110)_CS-F_ColG(111-1 118)
augaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaa

SEQ ID NO: 404 - RNA, 3105 nt, Artificial Sequence
  derived and/or modified CDS sequence (opt13) from Clostridium histolyticum__BAA34542.1__ColH
augaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaa

SEQ ID NO: 405 - RNA, 3066 nt, Artificial Sequence
  derived and/or modified CDS sequence (opt13) from Clostridium histolyticum__BAA34542.1__ColH
augaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaa

SEQ ID NO: 406 - RNA, 3000 nt, Artificial Sequence
  derived and/or modified CDS sequence (opt13) from Clostridium histolyticum__BAA34542.1__HsALB(1-18)_ColH(41-1021)
augaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaa

SEQ ID NO: 407 - RNA, 3138 nt, Artificial Sequence
  derived and/or modified CDS sequence (opt13) from Clostridium histolyticum__BAA34542.1__HsALB(1-18)_ColH(1-40)_CS-F_ColH(41-102 1)
augaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaa

SEQ ID NO: 408 - RNA, 1063 nt, Artificial Sequence
  mRNA product Design1 comprising derived and/or modified sequence from Homo sapiens__NP_003801.1__HsTNFSF10  (wt)
gggagaaagcuuaccauggcuaugauggagguccaggggggacccagccugggacagaccugcgugcugaucgugaucuucacagugcuccugcagucucucuguguggcuguaacuuacguguacuuuaccaacgagcugaagcagaugcaggacaaguacuccaaaaguggcauugcuuguuucuuaaaagaagaugacaguuauugggaccccaaugacgaagagaguaugaacagccccugcuggcaagucaaguggcaacuccgucagcucguuagaaagaugauuuugagaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 409 - RNA, 784 nt, Artificial Sequence
  mRNA product Design1 comprising derived and/or modified sequence from Homo sapiens__NP_003801.1__HsTNFSF10(95-281) (wt)
gggagaaagcuuaccaugaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 410 - RNA, 835 nt, Artificial Sequence
  mRNA product Design1 comprising derived and/or modified sequence from Homo sapiens__NP_003801.1__HsALB(1-18)_HsTNFSF10(95-281) (wt)
gggagaaagcuuaccaugaaguggguaaccuuuauuucccuucuuuuucucuuuagcucggcuuauuccaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 411 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (wt)
gggagaaagcuuaccaugaaguggguaaccuuuauuucccuucuuuuucucuuuagcucggcuuauuccagaaugaagcagaucgaggacaaaauugaagagauccugagcaagauuuaccacaucgaaaacgagauugccaggaucaaaaagcucauuggcgaaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 412 - RNA, 1294 nt, Artificial Sequence
  mRNA product Design1 comprising derived and/or modified sequence from Rattus norvegicus__NP_036656.1__RnCebpa (wt)
gggagaaagcuuaccauggagucggccgacuucuacgaggcggagccgcggcccccgaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 413 - RNA, 1252 nt, Artificial Sequence
  mRNA product Design1 comprising derived and/or modified sequence from Rattus norvegicus__NP_036656.1__RnCebpa(15-344) (wt)
gggagaaagcuuaccaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 414 - RNA, 1297 nt, Artificial Sequence
  mRNA product Design1 comprising derived and/or modified sequence from Mus musculus__NP_031704.2 __MmCebpa (wt)
gggagaaagcuuaccauggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 415 - RNA, 1255 nt, Artificial Sequence
  mRNA product Design1 comprising derived and/or modified sequence from Mus musculus__NP_031704.2 __MmCebpa(15-359) (wt)
gggagaaagcuuaccaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 416 - RNA, 1294 nt, Artificial Sequence
  mRNA product Design1 comprising derived and/or modified sequence from Homo sapiens__NP_004355.2__HsCEBPA (wt)
gggagaaagcuuaccauggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 417 - RNA, 1252 nt, Artificial Sequence
  mRNA product Design1 comprising derived and/or modified sequence from Homo sapiens__NP_004355.2__HsCEBPA (wt)
gggagaaagcuuaccaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 418 - RNA, 1294 nt, Artificial Sequence
  mRNA product Design1 comprising derived and/or modified sequence from Homo sapiens__NP_004355.2__HsCEBPA(15-358) (wt)
gggagaaagcuuaccauggagucggccgacuucuacgaggcggagccgcggcccccgaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 419 - RNA, 1252 nt, Artificial Sequence
  mRNA product Design1 comprising derived and/or modified sequence from Homo sapiens__NP_004355.2__HsCEBPA(15-358) (wt)
gggagaaagcuuaccaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 420 - RNA, 1642 nt, Artificial Sequence
  mRNA product Design1 comprising derived and/or modified sequence from Homo sapiens__NP_000448.3__HsHNF4A (wt)
gggagaaagcuuaccaugcgacucuccaaaacccucgucgacauggacauggccgacuacagugcugcacuggacccagccuacaccacccuggaauuugagaaugugcagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccugcugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 421 - RNA, 1642 nt, Artificial Sequence
  mRNA product Design1 comprising derived and/or modified sequence from Homo sapiens__NP_000448.3__HsHNF4A (wt)
gggagaaagcuuaccaugcgacucuccaaaacccucgucgacauggacauggccgacuacagugcugcacuggacccagccuacaccacccuggaauuugagaauguccagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccuccugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccagguccaggugagcuuggaggacuacaucaacgaccgccaguaugacucgcguggccgcuuuggagagcugcugcugcugcugcccaccuugcagagcaucaccuggcagaugaucgagcagauccaguucaucaagcuguucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 422 - RNA, 847 nt, Artificial Sequence
  mRNA product Design1 comprising derived and/or modified sequence from Homo sapiens__NP_061986.1__HsFGF21 (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 423 - RNA, 847 nt, Artificial Sequence
  mRNA product Design1 comprising derived and/or modified sequence from Homo sapiens__NP_061986.1__HsFGF21 (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 424 - RNA, 1573 nt, Artificial Sequence
  mRNA product Design1 comprising derived and/or modified sequence from Homo sapiens__NP_078852.3__HsOGFRL1 (wt)
gggagaaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaauucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaauucucaaccugagaaaacaguuacuacucccacagaaaaaaaggagaguguaucuccugagaauaacgaagaagguggaaaugauaaccaagacaaugaaaauccuggaaauacaaauugccaugauguuguacuaguacagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 425 - RNA, 1573 nt, Artificial Sequence
  mRNA product Design1 comprising derived and/or modified sequence from Homo sapiens__NP_078852.3__HsOGFRL1 (wt)
gggagaaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaguucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaacucucaaccugagaaaacaguuacuacucccacagaaaaaaaggagaguguaucuccugagaauaacgaagaagguggaaaugauaaccaagacaaugaaaauccuggaaauacaaauugccaugauguuguacuuguacagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 426 - RNA, 775 nt, Artificial Sequence
  mRNA product Design1 comprising derived and/or modified sequence from Homo sapiens__NP_008842.1__HsRLN1 (wt)
gggagaaagcuuaccaugccucgccuguucuuguuccaccugcuagaauucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaauucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 427 - RNA, 775 nt, Artificial Sequence
  mRNA product Design1 comprising derived and/or modified sequence from Homo sapiens__NP_008842.1__HsRLN1 (wt)
gggagaaagcuuaccaugccucgccuguucuuguuccaccuccuagaguucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaguucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 428 - RNA, 775 nt, Artificial Sequence
  mRNA product Design1 comprising derived and/or modified sequence from Homo sapiens__NP_604390.1__HsRLN2 (wt)
gggagaaagcuuaccaugccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 429 - RNA, 646 nt, Artificial Sequence
  mRNA product Design1 comprising derived and/or modified sequence from Homo sapiens__NP_543140.1__HsRLN3  (wt)
gggagaaagcuuaccauggccagguacaugcugcugcugcuccuggcgguaugggugcugaccggggagcuguggccgggagcugaggcccgggcagcgccuuacggggucaggcuuugcggccgagaauucauccgagcagucaucuucaccugcgggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 430 - RNA, 646 nt, Artificial Sequence
  mRNA product Design1 comprising derived and/or modified sequence from Homo sapiens__NP_543140.1__HsRLN3  (wt)
gggagaaagcuuaccauggccagguacaugcugcugcugcuccuggcgguaugggugcugaccggggagcuguggccgggagcugaggcccgggcagcgccuuacggggucaggcuuugcggccgagaguucauccgagcagucaucuucaccugugggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 431 - RNA, 1627 nt, Artificial Sequence
  mRNA product Design1 comprising derived and/or modified sequence from Homo sapiens__NP_002412.1__HsMMP1 (wt)
gggagaaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 432 - RNA, 1627 nt, Artificial Sequence
  mRNA product Design1 comprising derived and/or modified sequence from Homo sapiens__NP_002412.1__HsMMP1 (wt)
gggagaaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 433 - RNA, 1387 nt, Artificial Sequence
  mRNA product Design1 comprising derived and/or modified sequence from Homo sapiens__NP_002412.1__HsMMP1(1-19,100-469) (wt)
gggagaaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 434 - RNA, 3574 nt, Artificial Sequence
  mRNA product Design1 comprising derived and/or modified sequence from Clostridium histolyticum__BAA77453.1__ColG (wt)
gggagaaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 435 - RNA, 3574 nt, Artificial Sequence
  mRNA product Design1 comprising derived and/or modified sequence from Clostridium histolyticum__BAA77453.1__ColG (wt)
gggagaaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 436 - RNA, 3298 nt, Artificial Sequence
  mRNA product Design1 comprising derived and/or modified sequence from Clostridium histolyticum__BAA77453.1__HsALB(1-18)_ColG(111-1118) (wt)
gggagaaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 437 - RNA, 3298 nt, Artificial Sequence
  mRNA product Design1 comprising derived and/or modified sequence from Clostridium histolyticum__BAA77453.1__HsALB(1-18)_ColG(111-1118) (wt)
gggagaaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 438 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (wt)
gggagaaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 439 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (wt)
gggagaaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 440 - RNA, 3322 nt, Artificial Sequence
  mRNA product Design1 comprising derived and/or modified sequence from Clostridium histolyticum__BAA34542.1__ColH (wt)
gggagaaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 441 - RNA, 3322 nt, Artificial Sequence
  mRNA product Design1 comprising derived and/or modified sequence from Clostridium histolyticum__BAA34542.1__ColH (wt)
gggagaaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 442 - RNA, 3283 nt, Artificial Sequence
  mRNA product Design1 comprising derived and/or modified sequence from Clostridium histolyticum__BAA34542.1__ColH (wt)
gggagaaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 443 - RNA, 3283 nt, Artificial Sequence
  mRNA product Design1 comprising derived and/or modified sequence from Clostridium histolyticum__BAA34542.1__ColH (wt)
gggagaaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 444 - RNA, 3217 nt, Artificial Sequence
  mRNA product Design1 comprising derived and/or modified sequence from Clostridium histolyticum__BAA34542.1__HsALB(1-18)_ColH(41-1021) (wt)
gggagaaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 445 - RNA, 3217 nt, Artificial Sequence
  mRNA product Design1 comprising derived and/or modified sequence from Clostridium histolyticum__BAA34542.1__HsALB(1-18)_ColH(41-1021) (wt)
gggagaaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 446 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (wt)
gggagaaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 447 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (wt)
gggagaaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 448 - RNA, 1063 nt, Artificial Sequence
  mRNA product Design1 comprising derived and/or modified sequence from Homo sapiens__NP_003801.1__HsTNFSF10 (opt1)
gggagaaagcuuaccauggccaugauggaggugcagggcgggcccagccugggccagaccugcguccucaucgugaucuucaccgugcugcugcagucccucugcgucgccgugacguacguguacuucaccaacgagcugaagcagaugcaggacaaguacagcaaguccgggaucgcgugcuuccugaaggaggacgacagcuacugggacccgaacgacgaggaguccaugaacagcccgugcuggcaggucaaguggcagcuccgccagcuggugcggaagaugauccugcgcaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 449 - RNA, 784 nt, Artificial Sequence
  mRNA product Design1 comprising derived and/or modified sequence from Homo sapiens__NP_003801.1__HsTNFSF10(95-281) (opt1)
gggagaaagcuuaccaugaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 450 - RNA, 835 nt, Artificial Sequence
  mRNA product Design1 comprising derived and/or modified sequence from Homo sapiens__NP_003801.1__HsALB(1-18)_HsTNFSF10(95-281) (opt1)
gggagaaagcuuaccaugaagugggugaccuucaucagccugcucuuccuguucuccagcgccuacuccaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 451 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt1)
gggagaaagcuuaccaugaagugggugaccuucaucagccugcucuuccuguucuccagcgccuacucccgcaugaagcagaucgaggacaagaucgaggagauccugagcaagaucuaccacaucgagaacgagaucgcccggaucaagaagcucaucggcgagaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 452 - RNA, 1294 nt, Artificial Sequence
  mRNA product Design1 comprising derived and/or modified sequence from Rattus norvegicus__NP_036656.1__RnCebpa (opt1)
gggagaaagcuuaccauggagagcgccgacuucuacgaggccgagccccgcccgcccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 453 - RNA, 1252 nt, Artificial Sequence
  mRNA product Design1 comprising derived and/or modified sequence from Rattus norvegicus__NP_036656.1__RnCebpa(15-344) (opt1)
gggagaaagcuuaccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 454 - RNA, 1297 nt, Artificial Sequence
  mRNA product Design1 comprising derived and/or modified sequence from Mus musculus__NP_031704.2 __MmCebpa (opt1)
gggagaaagcuuaccauggagagcgccgacuucuacgagguggagccccgcccgcccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 455 - RNA, 1255 nt, Artificial Sequence
  mRNA product Design1 comprising derived and/or modified sequence from Mus musculus__NP_031704.2 __MmCebpa(15-359) (opt1)
gggagaaagcuuaccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 456 - RNA, 1294 nt, Artificial Sequence
  mRNA product Design1 comprising derived and/or modified sequence from Homo sapiens__NP_004355.2__HsCEBPA (opt1)
gggagaaagcuuaccauggagagcgccgacuucuacgaggccgagccccgcccgcccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 457 - RNA, 1252 nt, Artificial Sequence
  mRNA product Design1 comprising derived and/or modified sequence from Homo sapiens__NP_004355.2__HsCEBPA(15-358) (opt1)
gggagaaagcuuaccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 458 - RNA, 1642 nt, Artificial Sequence
  mRNA product Design1 comprising derived and/or modified sequence from Homo sapiens__NP_000448.3__HsHNF4A (opt1)
gggagaaagcuuaccaugcgccugagcaagacccucguggacauggacauggccgacuacuccgccgcgcuggaccccgccuacaccacgcuggaguucgagaacguccaggugcucaccaugggcaacgacaccagcccguccgaggggaccaaccugaacgcccccaacagccugggcguguccgcccucugcgccaucugcggggaccgggcgacgggcaagcacuacggggccagcuccugcgacggcugcaagggcuucuuccgccggagcguccgcaagaaccacauguacuccugccgguucagccgccagugcgugguggacaaggacaagcggaaccagugccgcuacugccggcugaagaagugcuuccgcgccgggaugaagaaggaggccguccagaacgagcgggaccgcaucuccacccggcgcagcuccuacgaggacagcucccugcccagcaucaacgcgcuccugcaggccgaggugcugucccggcagaucaccagccccguguccggcaucaacggggacauccgcgccaagaagaucgccagcaucgccgacgucugcgagagcaugaaggagcagcuccuggugcugguggagugggcgaaguacaucccggccuucugcgagcucccccuggacgaccaggucgcccugcuccgggcccacgccggcgagcaccuccugcugggggcgaccaagcgcuccaugguguucaaggacgugcugcugcucggcaacgacuacaucgucccccggcacugccccgagcuggccgagaugagccgcguguccauccggauccuggacgagcucgugcugccguuccaggagcugcagaucgacgacaacgaguacgccuaccucaaggccaucaucuucuucgaccccgacgccaagggccugagcgaccccgggaagaucaagcgccugcgcucccagguccaggugagccucgaggacuacaucaacgaccggcaguacgacucccgcggccgguucggggagcugcugcuccugcugcccacgcuccagagcaucaccuggcagaugaucgagcagauccaguucaucaagcuguucggcauggcgaagaucgacaaccugcuccaggagaugcugcugggcggguccccgagcgacgcgccccacgcccaccacccccuccacccccaccugaugcaggagcacaugggcaccaacgugaucgucgccaacaccaugccgacgcaccuguccaacgggcagaugugcgaguggccccgcccccggggccaggccgccacccccgagaccccgcagcccagcccgcccgggggcuccggcagcgagcccuacaagcuccugcccggggccguggccaccaucgugaagccccuguccgccaucccccagccgacgaucaccaagcaggaggucaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 459 - RNA, 847 nt, Artificial Sequence
  mRNA product Design1 comprising derived and/or modified sequence from Homo sapiens__NP_061986.1__HsFGF21 (opt1)
gggagaaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 460 - RNA, 1573 nt, Artificial Sequence
  mRNA product Design1 comprising derived and/or modified sequence from Homo sapiens__NP_078852.3__HsOGFRL1 (opt1)
gggagaaagcuuaccaugggcaaccugcucgggggcgugagcuuccgcgagcccaccaccgucgaggacugcgacuccacguggcagaccgacagcgagccggagcccgaggagcccgggcccggcgggggcuccgagggcccggggcaggagagcgagcagcccgcccagccgcccgagcaggccggcgggcggcccggcgcgucccccgcccccgacgaggacgccgaggccgccggggcggagcagggcggcgacagcaccgaggccaccgccaagcccaagcgcuccuucuacgccgcgcgggaccuguacaaguaccgccaccaguacccgaacuucaaggacauccgguaccagaacgaccugagcaaccuccgcuucuacaagaacaagauccccuucaagcccgacgggguguacaucgaggaggugcuguccaaguggaagggcgacuacgagaagcuggagcacaaccacacguacauccaguggcuguucccccuccgggagcaggggcugaacuucuacgccaaggagcucaccaccuacgagaucgaggaguucaagaagaccaaggaggccauccgccgguuccugcuggccuacaagaugaugcucgaguucuucggcaucaagcugacggacaagaccggcaacgucgcccgcgcggugaacuggcaggagcgguuccagcaccugaacgagagccagcacaacuaccuccgcaucacccggauccugaagucccugggggagcucggcuacgagagcuucaaguccccgcuggugaaguucauccugcacgaggcccucgucgagaacaccauccccaacaucaagcagagcgcccuggaguacuucguguacacgauccgcgaccggcgcgagcggcgcaagcugcuccgguucgcccagaagcacuacacccccuccgagaacuucaucugggggcccccgcgcaaggagcagagcgagggcuccaaggcccagaagaugagcagcccccuggcguccagccacaacucccagaccagcaugcacaagaaggccaaggacuccaagaacagcuccagcgccgugcaccugaacuccaagaccgccgaggacaagaaggucgcccccaaggagcccguggaggagacggaccggccgagccccgagcccuccaacgaggcggccaagccccgcaacaccgagaaggacagcaacgccgagaacaugaacucccagccggagaagaccgugaccacgcccaccgagaagaaggagagcgucucccccgagaacaacgaggagggcgggaacgacaaccaggacaacgagaacccgggcaacaccaacugccacgacguggugcucguccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 461 - RNA, 775 nt, Artificial Sequence
  mRNA product Design1 comprising derived and/or modified sequence from Homo sapiens__NP_008842.1__HsRLN1 (opt1)
gggagaaagcuuaccaugccccgccuguuccucuuccaccuccuggaguucugccugcugcugaaccaguucagccgggccguggccgcgaaguggaaggacgacgucaucaagcucugcggccgcgagcuggugcgggcccagaucgccaucugcgggauguccaccuggagcaagcgcucccugagccaggaggacgccccgcagacgccccggcccguggccgagaucguccccuccuucaucaacaaggacaccgagaccaucaucaucaugcucgaguucaucgcgaaccugccgcccgagcugaaggccgcccucagcgagcgccagcccucccugcccgagcugcagcaguacgugccggcccucaaggacagcaaccuguccuucgaggaguucaagaagcugauccggaaccgccagagcgaggcggccgacuccaaccccagcgagcucaaguaccugggccuggacacccacucccagaagaagcggcgccccuacguggcccucuucgagaagugcugccugaucgggugcaccaagcggagccuggccaaguacugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 462 - RNA, 775 nt, Artificial Sequence
  mRNA product Design1 comprising derived and/or modified sequence from Homo sapiens__NP_604390.1__HsRLN2 (opt1)
gggagaaagcuuaccaugccccgccuguucuucuuccaccuccugggcgugugccugcuccugaaccaguucagccgggccgucgccgacuccuggauggaggaggugaucaagcugugcgggcgcgagcucgugcgggcgcagaucgccaucugcggcaugagcaccugguccaagcgcagccugucccaggaggacgccccgcagacgccccggcccgucgccgagaucgugcccagcuucaucaacaaggacaccgagaccaucaacaugauguccgaguucguggccaaccugccgcaggagcucaagcugacccugagcgagaugcagcccgcgcucccccagcugcagcagcacguccccgugcugaaggacuccagccuccuguucgaggaguucaagaagcugauccgcaaccggcaguccgaggccgccgacagcuccccgagcgagcucaaguaccuggggcuggacacccacucccgcaagaagcggcagcucuacagcgcccuggcgaacaagugcugccacgugggcugcacgaagcgcucccuggcccgguucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 463 - RNA, 646 nt, Artificial Sequence
  mRNA product Design1 comprising derived and/or modified sequence from Homo sapiens__NP_543140.1__HsRLN3  (opt1)
gggagaaagcuuaccauggcccgcuacaugcugcuccugcugcucgccguguggguccugaccggcgagcuguggcccggggcggaggcccgggccgccccguacggcgugcgccucugcgggcgggaguucauccgcgccgugaucuucacgugcggcgggagccgguggcgccgguccgacauccuggcgcacgaggccaugggcgacaccuuccccgacgccgacgccgacgaggacagccuggcgggcgagcucgacgaggccaugggguccagcgaguggcuggcccugaccaagagcccccaggccuucuaccgcggccggcccuccuggcaggggaccccgggcguccuccgcgggucccgggacgugcuggccggccugagcuccagcugcugcaaguggggcugcuccaagagcgagaucuccagccucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 464 - RNA, 1627 nt, Artificial Sequence
  mRNA product Design1 comprising derived and/or modified sequence from Homo sapiens__NP_002412.1__HsMMP1 (opt1)
gggagaaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 465 - RNA, 1387 nt, Artificial Sequence
  mRNA product Design1 comprising derived and/or modified sequence from Homo sapiens__NP_002412.1__HsMMP1(1-19,100-469) (opt1)
gggagaaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 466 - RNA, 3574 nt, Artificial Sequence
  mRNA product Design1 comprising derived and/or modified sequence from Clostridium histolyticum__BAA77453.1__ColG (opt1)
gggagaaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 467 - RNA, 3298 nt, Artificial Sequence
  mRNA product Design1 comprising derived and/or modified sequence from Clostridium histolyticum__BAA77453.1__HsALB(1-18)_ColG(111-1118) (opt1)
gggagaaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 468 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt1)
gggagaaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 469 - RNA, 3322 nt, Artificial Sequence
  mRNA product Design1 comprising derived and/or modified sequence from Clostridium histolyticum__BAA34542.1__ColH (opt1)
gggagaaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 470 - RNA, 3283 nt, Artificial Sequence
  mRNA product Design1 comprising derived and/or modified sequence from Clostridium histolyticum__BAA34542.1__ColH (opt1)
gggagaaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 471 - RNA, 3217 nt, Artificial Sequence
  mRNA product Design1 comprising derived and/or modified sequence from Clostridium histolyticum__BAA34542.1__HsALB(1-18)_ColH(41-1021) (opt1)
gggagaaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 472 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt1)
gggagaaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 473 - RNA, 1063 nt, Artificial Sequence
  mRNA product Design1 comprising derived and/or modified sequence from Homo sapiens__NP_003801.1__HsTNFSF10 (opt2)
gggagaaagcuuaccauggccaugauggagguccagggcggccccucccucggccagaccugcguccucaucgucaucuucaccguccuccuccagucccucugcgucgccgucaccuacgucuacuucaccaacgagcucaagcagaugcaggacaaguacuccaaguccggcaucgccugcuuccucaaggaggacgacuccuacugggaccccaacgacgaggaguccaugaacucccccugcuggcaggucaaguggcagcuccgccagcucguccgcaagaugauccuccgcaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 474 - RNA, 784 nt, Artificial Sequence
  mRNA product Design1 comprising derived and/or modified sequence from Homo sapiens__NP_003801.1__HsTNFSF10(95-281) (opt2)
gggagaaagcuuaccaugaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 475 - RNA, 835 nt, Artificial Sequence
  mRNA product Design1 comprising derived and/or modified sequence from Homo sapiens__NP_003801.1__HsALB(1-18)_HsTNFSF10(95-281) (opt2)
gggagaaagcuuaccaugaagugggucaccuucaucucccuccucuuccucuucuccuccgccuacuccaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 476 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt2)
gggagaaagcuuaccaugaagugggucaccuucaucucccuccucuuccucuucuccuccgccuacucccgcaugaagcagaucgaggacaagaucgaggagauccucuccaagaucuaccacaucgagaacgagaucgcccgcaucaagaagcucaucggcgagaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 477 - RNA, 1294 nt, Artificial Sequence
  mRNA product Design1 comprising derived and/or modified sequence from Rattus norvegicus__NP_036656.1__RnCebpa (opt2)
gggagaaagcuuaccauggaguccgccgacuucuacgaggccgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 478 - RNA, 1252 nt, Artificial Sequence
  mRNA product Design1 comprising derived and/or modified sequence from Rattus norvegicus__NP_036656.1__RnCebpa(15-344) (opt2)
gggagaaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 479 - RNA, 1297 nt, Artificial Sequence
  mRNA product Design1 comprising derived and/or modified sequence from Mus musculus__NP_031704.2 __MmCebpa (opt2)
gggagaaagcuuaccauggaguccgccgacuucuacgaggucgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 480 - RNA, 1255 nt, Artificial Sequence
  mRNA product Design1 comprising derived and/or modified sequence from Mus musculus__NP_031704.2 __MmCebpa(15-359) (opt2)
gggagaaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 481 - RNA, 1294 nt, Artificial Sequence
  mRNA product Design1 comprising derived and/or modified sequence from Homo sapiens__NP_004355.2__HsCEBPA (opt2)
gggagaaagcuuaccauggaguccgccgacuucuacgaggccgagccccgcccccccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 482 - RNA, 1252 nt, Artificial Sequence
  mRNA product Design1 comprising derived and/or modified sequence from Homo sapiens__NP_004355.2__HsCEBPA(15-358) (opt2)
gggagaaagcuuaccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 483 - RNA, 1642 nt, Artificial Sequence
  mRNA product Design1 comprising derived and/or modified sequence from Homo sapiens__NP_000448.3__HsHNF4A (opt2)
gggagaaagcuuaccaugcgccucuccaagacccucgucgacauggacauggccgacuacuccgccgcccucgaccccgccuacaccacccucgaguucgagaacguccagguccucaccaugggcaacgacaccucccccuccgagggcaccaaccucaacgcccccaacucccucggcgucuccgcccucugcgccaucugcggcgaccgcgccaccggcaagcacuacggcgccuccuccugcgacggcugcaagggcuucuuccgccgcuccguccgcaagaaccacauguacuccugccgcuucucccgccagugcgucgucgacaaggacaagcgcaaccagugccgcuacugccgccucaagaagugcuuccgcgccggcaugaagaaggaggccguccagaacgagcgcgaccgcaucuccacccgccgcuccuccuacgaggacuccucccuccccuccaucaacgcccuccuccaggccgagguccucucccgccagaucaccucccccgucuccggcaucaacggcgacauccgcgccaagaagaucgccuccaucgccgacgucugcgaguccaugaaggagcagcuccucguccucgucgagugggccaaguacauccccgccuucugcgagcucccccucgacgaccaggucgcccuccuccgcgcccacgccggcgagcaccuccuccucggcgccaccaagcgcuccauggucuucaaggacguccuccuccucggcaacgacuacaucgucccccgccacugccccgagcucgccgagaugucccgcgucuccauccgcauccucgacgagcucguccuccccuuccaggagcuccagaucgacgacaacgaguacgccuaccucaaggccaucaucuucuucgaccccgacgccaagggccucuccgaccccggcaagaucaagcgccuccgcucccagguccaggucucccucgaggacuacaucaacgaccgccaguacgacucccgcggccgcuucggcgagcuccuccuccuccuccccacccuccaguccaucaccuggcagaugaucgagcagauccaguucaucaagcucuucggcauggccaagaucgacaaccuccuccaggagaugcuccucggcggcucccccuccgacgccccccacgcccaccacccccuccacccccaccucaugcaggagcacaugggcaccaacgucaucgucgccaacaccaugcccacccaccucuccaacggccagaugugcgaguggccccgcccccgcggccaggccgccacccccgagaccccccagcccuccccccccggcggcuccggcuccgagcccuacaagcuccuccccggcgccgucgccaccaucgucaagccccucuccgccaucccccagcccaccaucaccaagcaggaggucaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 484 - RNA, 847 nt, Artificial Sequence
  mRNA product Design1 comprising derived and/or modified sequence from Homo sapiens__NP_061986.1__HsFGF21 (opt2)
gggagaaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 485 - RNA, 1573 nt, Artificial Sequence
  mRNA product Design1 comprising derived and/or modified sequence from Homo sapiens__NP_078852.3__HsOGFRL1 (opt2)
gggagaaagcuuaccaugggcaaccuccucggcggcgucuccuuccgcgagcccaccaccgucgaggacugcgacuccaccuggcagaccgacuccgagcccgagcccgaggagcccggccccggcggcggcuccgagggccccggccaggaguccgagcagcccgcccagccccccgagcaggccggcggccgccccggcgccucccccgcccccgacgaggacgccgaggccgccggcgccgagcagggcggcgacuccaccgaggccaccgccaagcccaagcgcuccuucuacgccgcccgcgaccucuacaaguaccgccaccaguaccccaacuucaaggacauccgcuaccagaacgaccucuccaaccuccgcuucuacaagaacaagauccccuucaagcccgacggcgucuacaucgaggagguccucuccaaguggaagggcgacuacgagaagcucgagcacaaccacaccuacauccaguggcucuucccccuccgcgagcagggccucaacuucuacgccaaggagcucaccaccuacgagaucgaggaguucaagaagaccaaggaggccauccgccgcuuccuccucgccuacaagaugaugcucgaguucuucggcaucaagcucaccgacaagaccggcaacgucgcccgcgccgucaacuggcaggagcgcuuccagcaccucaacgagucccagcacaacuaccuccgcaucacccgcauccucaagucccucggcgagcucggcuacgaguccuucaaguccccccucgucaaguucauccuccacgaggcccucgucgagaacaccauccccaacaucaagcaguccgcccucgaguacuucgucuacaccauccgcgaccgccgcgagcgccgcaagcuccuccgcuucgcccagaagcacuacacccccuccgagaacuucaucuggggccccccccgcaaggagcaguccgagggcuccaaggcccagaagauguccuccccccucgccuccucccacaacucccagaccuccaugcacaagaaggccaaggacuccaagaacuccuccuccgccguccaccucaacuccaagaccgccgaggacaagaaggucgcccccaaggagcccgucgaggagaccgaccgccccucccccgagcccuccaacgaggccgccaagccccgcaacaccgagaaggacuccaacgccgagaacaugaacucccagcccgagaagaccgucaccacccccaccgagaagaaggaguccgucucccccgagaacaacgaggagggcggcaacgacaaccaggacaacgagaaccccggcaacaccaacugccacgacgucguccucguccagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 486 - RNA, 775 nt, Artificial Sequence
  mRNA product Design1 comprising derived and/or modified sequence from Homo sapiens__NP_008842.1__HsRLN1 (opt2)
gggagaaagcuuaccaugccccgccucuuccucuuccaccuccucgaguucugccuccuccucaaccaguucucccgcgccgucgccgccaaguggaaggacgacgucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaucaucaugcucgaguucaucgccaaccucccccccgagcucaaggccgcccucuccgagcgccagcccucccuccccgagcuccagcaguacguccccgcccucaaggacuccaaccucuccuucgaggaguucaagaagcucauccgcaaccgccaguccgaggccgccgacuccaaccccuccgagcucaaguaccucggccucgacacccacucccagaagaagcgccgccccuacgucgcccucuucgagaagugcugccucaucggcugcaccaagcgcucccucgccaaguacugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 487 - RNA, 775 nt, Artificial Sequence
  mRNA product Design1 comprising derived and/or modified sequence from Homo sapiens__NP_604390.1__HsRLN2 (opt2)
gggagaaagcuuaccaugccccgccucuucuucuuccaccuccucggcgucugccuccuccucaaccaguucucccgcgccgucgccgacuccuggauggaggaggucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 488 - RNA, 646 nt, Artificial Sequence
  mRNA product Design1 comprising derived and/or modified sequence from Homo sapiens__NP_543140.1__HsRLN3  (opt2)
gggagaaagcuuaccauggcccgcuacaugcuccuccuccuccucgccgucuggguccucaccggcgagcucuggcccggcgccgaggcccgcgccgcccccuacggcguccgccucugcggccgcgaguucauccgcgccgucaucuucaccugcggcggcucccgcuggcgccgcuccgacauccucgcccacgaggccaugggcgacaccuuccccgacgccgacgccgacgaggacucccucgccggcgagcucgacgaggccaugggcuccuccgaguggcucgcccucaccaaguccccccaggccuucuaccgcggccgccccuccuggcagggcacccccggcguccuccgcggcucccgcgacguccucgccggccucuccuccuccugcugcaaguggggcugcuccaaguccgagaucuccucccucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 489 - RNA, 1627 nt, Artificial Sequence
  mRNA product Design1 comprising derived and/or modified sequence from Homo sapiens__NP_002412.1__HsMMP1 (opt2)
gggagaaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 490 - RNA, 1387 nt, Artificial Sequence
  mRNA product Design1 comprising derived and/or modified sequence from Homo sapiens__NP_002412.1__HsMMP1(1-19,100-469) (opt2)
gggagaaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 491 - RNA, 3574 nt, Artificial Sequence
  mRNA product Design1 comprising derived and/or modified sequence from Clostridium histolyticum__BAA77453.1__ColG (opt2)
gggagaaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 492 - RNA, 3298 nt, Artificial Sequence
  mRNA product Design1 comprising derived and/or modified sequence from Clostridium histolyticum__BAA77453.1__HsALB(1-18)_ColG(111-1118) (opt2)
gggagaaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 493 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt2)
gggagaaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 494 - RNA, 3322 nt, Artificial Sequence
  mRNA product Design1 comprising derived and/or modified sequence from Clostridium histolyticum__BAA34542.1__ColH (opt2)
gggagaaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 495 - RNA, 3283 nt, Artificial Sequence
  mRNA product Design1 comprising derived and/or modified sequence from Clostridium histolyticum__BAA34542.1__ColH (opt2)
gggagaaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 496 - RNA, 3217 nt, Artificial Sequence
  mRNA product Design1 comprising derived and/or modified sequence from Clostridium histolyticum__BAA34542.1__HsALB(1-18)_ColH(41-1021) (opt2)
gggagaaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 497 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt2)
gggagaaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 498 - RNA, 271 nt, Artificial Sequence
  mRNA product Design1 comprising derived and/or modified sequence from Homo sapiens__NP_000468.1__signal peptide-HsALB (opt3)
gggagaaagcuuaccaugaagugggugaccuucaucagccugcucuuucuuuucuccucugccuacucaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 499 - RNA, 313 nt, Artificial Sequence
  mRNA product Design1 comprising derived and/or modified sequence from Artificial__1GCM_A__isoleucinze zipper-ILZ (opt3)
gggagaaagcuuaccagaaugaagcagaucgaggacaaaauugaagagauacugagcaagaucuaccacauugaaaacgagaucgccaggauuaaaaagcucaucggcgaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 500 - RNA, 235 nt, Artificial Sequence
  mRNA product Design1 comprising derived and/or modified sequence from Artificial____cleavage site-Furin (opt3)
gggagaaagcuuaccagaaggcggcgcaagcgaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 501 - RNA, 1063 nt, Artificial Sequence
  mRNA product Design1 comprising derived and/or modified sequence from Homo sapiens__NP_003801.1__HsTNFSF10 (opt3)
gggagaaagcuuaccauggccaugauggaggugcagggcgggcccagccugggacaaaccugcguccucaucguuauuuucacagugcuucugcaguccuuguguguagcugugacuuacgucuauuuuacgaacgaauuaaagcagaugcaggacaaauacucuaagucagguauagcaugcuuccugaaagaggaugacaguuauugggauccuaaugacgaagagagcaugaacuccccauguuggcaagugaaguggcagcuaagacagcucguuaggaaaaugauccugcggaccucugaagagacaauuucgacugugcaggagaagcaacagaauaucucaccgcuuguccgcgaacgaggcccccagcguguggccgcgcacauuaccgggacaagaggaaggagcaacacccugaguuccccuaauucuaagaacgagaaggcuuugggccggaaaaucaauagcugggaauccucacgcaguggucauagcuuucucucuaaccugcaccugagaaauggggagcucguaauacaugagaaaggauucuacuauaucuacucccagacuuauuuuagguuccaagaagagauuaaggaaaacaccaaaaaugauaagcagaugguucaguacaucuacaaguauacaucauacccagaccccauuuuacugaugaaaagcgcccggaacaguugcuggucuaaggaugcagaguauggccuuuacuccaucuaucaaggcgggauauuugaauugaaagagaaugaccgcauuuucgugagcgucacgaacgagcaccugaucgauauggaccaugaagccucguuuuucggagcuuuucuaguggguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 502 - RNA, 784 nt, Artificial Sequence
  mRNA product Design1 comprising derived and/or modified sequence from Homo sapiens__NP_003801.1__HsTNFSF10(95-281) (opt3)
gggagaaagcuuaccaugaccagcgaagaaacaaucuccacugugcaggagaagcaacagaacauuucuccccuggucagagaaaggggcccucagcggguugccgcucacauaacggggacccgcggacgaucaaauacacucaguagcccaaacuccaaaaaugagaaggcacuuggucguaaaaucaacucuugggaaucgucaagaagcggccauaguuuccuguccaauuugcacuuaaggaacggggagcuggugauucaugagaagggauuuuacuauaucuacucucagacuuauuuccgguuucaagaagagauuaaagaaaauaccaagaacgacaagcagaugguacaguacaucuauaaauacacaagcuauccggaucccauacuacucaugaaguccgcccgcaauucaugcuggaguaaagacgcggaguacggccuguacagcaucuaucagggugggauuuucgagcuuaaggaaaacgauagaaucuuugugucugucaccaaugagcaccugauugacauggaucaugaggcuuccuucuuuggagccuucuuggugggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 503 - RNA, 835 nt, Artificial Sequence
  mRNA product Design1 comprising derived and/or modified sequence from Homo sapiens__NP_003801.1__HsALB(1-18)_HsTNFSF10(95-281) (opt3)
gggagaaagcuuaccaugaagugggugaccuucaucagccugcucuuucuuuucuccucugccuacucaacaagugaggaaacuauuagcacgguccaggagaaacaacagaacauaucuccccugguuagagaaaggggcccucagcggguggcugcacacaucaccgggacacgcggacgaucuaauacuuugucgucaccaaacagcaagaaugagaaagccuuaggucguaagauuaacaguugggaauccucuagaagcggccauuccuuucugucaaaucuacaccucaggaacggggagcugguaauccaugagaaaggauucuauuacauuuauagucagaccuacuuucgguuccaagaagagaucaaggaaaauacaaagaacgacaaacagauggugcaguauauauacaaguauaccagcuacccggaucccauccuucugaugaaaucugcgcgcaauuccugcuggucaaaggacgcugaguacggcuuguauagcauuuaccagggugggaucuuugagcucaaagaaaacgauagaauuuucgucagugugacuaaugagcaccugaucgacauggaucaugaagccuccuuuuucggagcauuucugguuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 504 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt3)
gggagaaagcuuaccaugaagugggugaccuucaucagccugcucuuucuuuucuccucugccuacucaagaaugaaacagauugaggacaagauagaagagauccugaguaaaauuuaucacaucgaaaacgagauugcuaggaucaagaaauugauaggcgaaacaagcgaggagacuaucuccacgguccaagaaaagcagcagaauauuucucccuuaguucgggagcgcgggccucagcgaguggcagcccauaucaccggaacacgugguagaucgaacacucugucaagcccaaauaguaagaacgaaaaagcgcuaggcaggaagauuaauuccugggagucuagccgguccgggcacucauuucucaguaaccugcaucuucgcaauggagagcugguaauccacgaaaaaggcuucuacuauauauacagccaaaccuauuuuagauuccaggaggaaauuaaggagaacaccaaaaaugauaagcagauggugcaguacaucuauaaguacacaucuuacccggaccccauuuugcucaugaaauccgcuaggaacucaugcuggagcaaggaugccgaauauggucuguacaguaucuaucaagggggaaucuuugagcugaaagagaaugaccggauuuucgucucugugacuaacgaacaucucauagauauggaccacgaggcauccuuuuucggcgccuuuuuaguuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 505 - RNA, 1294 nt, Artificial Sequence
  mRNA product Design1 comprising derived and/or modified sequence from Rattus norvegicus__NP_036656.1__RnCebpa (opt3)
gggagaaagcuuaccauggagagcgccgacuucuacgaagcugagcccagaccuccaauguccucucaucugcagucaccgccccacgcaccuaguaacgccgcguuuggcuucccaaggggagcugggcccgccccuccacccgcaccuccagccgcuccggaaccccucgguggcaucugcgagcacgaaaccagcauugauauauccgcauauaucgacccugccgcuuuuaaugaugaguuccuugccgaccuguuucaacauucucggcagcaggagaaggcgaaagcagccgcugggccagccggaggcgguggggauuucgacuaccccggagcuccugcaggcccaggcggggccgugaugucggcgggagcccacggucccccgccuggcuaugggugugcagcugccggauacuuggauggccgcuuagaaccccuguaugagcgagucggugcuccagcccuacguccucucguuauuaagcaggaacccagagaggaggacgaagcaaaacaacuggcccuugcugggcuguuuccauaccagcccccuccaccgcccccuccaccccauccucacgcgucaccagcacacuuggccgcuccccaucuccaguuccagaucgcccacugcggacaaacaacuaugcaucugcagccgggccacccuacgccacccccuacccccgugccaagcccucaccccgcaccagccaugggcgcugccgggcugccgggaccugguggcagucucaagggguuagcaggaccccauccagaucugaggacaggcggugggggcggaggcggggcgggagcugguaaagccaagaaguccguagacaaaaacucuaaugaguaucgggugcgcagagaaaggaacaauauugcaguccgcaagagccgggauaaagccaagcagcgaaacguggagacucagcaaaaaguucuugaauugaccuccgacaaugauagacugaggaagcggguggagcagcuaucacgugagcucgacacacugcgcggcaucuuuagacagcuucccgaaaguagccuggucaaggcuauggggaacugugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 506 - RNA, 1252 nt, Artificial Sequence
  mRNA product Design1 comprising derived and/or modified sequence from Rattus norvegicus__NP_036656.1__RnCebpa(15-344) (opt3)
gggagaaagcuuaccaugagcucccaucugcagucucccccucacgccccaucaaacgcugcauucggcuuuccgagaggggccggacccgcgccuccacccgcuccuccagccgcacccgagccucucgguggcaucugcgaacacgagaccaguauugacauaagcgccuacaucgauccagcugcauucaaugacgaauuucuugccgaucuguuccaacauuccaggcagcaggagaaggcuaaagccgcggcagggccggccggaggcgguggggacuuugauuaucccggagcuccugccggcccaggcggggcagugaugucugcuggagcccacggucccccuccaggcuacgggugugcggccgcaggauauuuggacggccgguuagaaccccuguacgagcgcgucggugcuccggcccuacgaccucucguuauuaagcaggagccccgugaagaggaugaagcuaaacaacuggcccuugcagggcuguucccauaucagccucccccacccccuccaccgccccauccucacgccucgccagcucacuuggcggcaccccaucuccaguuucagaucgcccacugcggacaaacaacuaugcaucugcagccuggccacccaacgcccccgccuaccccagugcccucaccucaccccgcuccagccaugggcgcagccgggcugccuggacccgguggcagccucaagggguuagcuggaccacauccggaccugagaacaggcggugggggcggaggcggggccggagcagguaaagcgaagaagaguguagauaaaaacuccaaugaguacagggugcggcgcgagagaaacaauauugcugucaggaagucucgggacaaagccaagcagcgcaacguggaaacucagcaaaaaguucuugaguugaccagcgauaaugaccgacugagaaagaggguggaacagcuaucccgggagcucgauacacugcguggcaucuuccgccagcuuccugaaucaagucuggucaaggcaauggggaacugugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 507 - RNA, 1297 nt, Artificial Sequence
  mRNA product Design1 comprising derived and/or modified sequence from Mus musculus__NP_031704.2 __MmCebpa (opt3)
gggagaaagcuuaccauggaaagcgccgacuucuacgagguggaacccagaccuccuaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 508 - RNA, 1255 nt, Artificial Sequence
  mRNA product Design1 comprising derived and/or modified sequence from Mus musculus__NP_031704.2 __MmCebpa(15-359) (opt3)
gggagaaagcuuaccaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 509 - RNA, 1294 nt, Artificial Sequence
  mRNA product Design1 comprising derived and/or modified sequence from Homo sapiens__NP_004355.2__HsCEBPA (opt3)
gggagaaagcuuaccauggagagcgccgacuucuacgaagcugagcccagaccuccaauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 510 - RNA, 1252 nt, Artificial Sequence
  mRNA product Design1 comprising derived and/or modified sequence from Homo sapiens__NP_004355.2__HsCEBPA(15-358) (opt3)
gggagaaagcuuaccauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 511 - RNA, 1642 nt, Artificial Sequence
  mRNA product Design1 comprising derived and/or modified sequence from Homo sapiens__NP_000448.3__HsHNF4A (opt3)
gggagaaagcuuaccaugagacugagcaagacccucguggacauggauauggccgacuacuccgcugcacuugaucccgccuauacaacucuggaguucgaaaacguccagguuuugacgaugggcaaugacaccucuccuucagaggggacaaacuuaaaugcgccaaacagucugggagugagcgcucuaugcgccaucuguggugauagggcaacuggcaaacacuacggggccuccucuugcgacggauguaagggcuuuuuccggcgcucgguacguaaaaaucauauguauucaugccgauuuagcagacaauguguggucgauaaggacaaaaggaaccagugccgguacugucgccucaagaagugcuucagagcugguaugaaaaaggaagcagugcagaaugagagggaucggauuaguacccgccgauccucuuaugaagacagcucccugccgucaauaaacgcccuucugcaggcugagguuuugaguagacaaaucacaagccccgugucugggauuaauggagauaucagggccaaaaagauugcguccaucgcagacgucugugagucaaugaaagaacagcuccuggugcugguagagugggccaaguacauaccugcuuuuugcgaacucccauuagaugaccagguugcccugcuucgggcacacgcuggcgagcauuugcugcuaggcgccaccaagcguagcaugguguucaaagacguccuccugcuugggaacgauuauaucgugccccgccacuguccugagcuggcggaaaugaguagagugucuauuaggaucuuggacgagcucguccugccauuucaggaauuacaaauugaugacaaugaguacgccuaccugaaggcaaucauauucuuugaucccgacgcuaaaggacucuccgauccugguaagauuaaacggcuucgaagccagguucaggugucgcuggaagacuauaucaacgaucgccaguacgacucuagaggcagguucggggaguugcuacugcuccugccaacucuucaauccauuacauggcagaugaucgagcagauccaauuuauuaagcuguucggaauggccaaaauagauaauuugcuccaggaaaugcuguuaggcgguucaccgagugacgcuccccaugcccaccacccucugcauccacaccuaaugcaggagcauauggggaccaacguaaucguggcaaauacgaugcccacucaccucagcaacggacagaugugcgaauggccucggccacgcggccaagccgcuacccccgagacaccgcagccuucucccccaggcggguccggaagcgaaccuuauaagcugcuucccggugcggucgcaacuauugugaagccauugucagccaucccccagccuaccauaacaaaacaggagguuauuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 512 - RNA, 847 nt, Artificial Sequence
  mRNA product Design1 comprising derived and/or modified sequence from Homo sapiens__NP_061986.1__HsFGF21 (opt3)
gggagaaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 513 - RNA, 1573 nt, Artificial Sequence
  mRNA product Design1 comprising derived and/or modified sequence from Homo sapiens__NP_078852.3__HsOGFRL1 (opt3)
gggagaaagcuuaccaugggcaaccugcucgggggagugagcuucagagagcccaccacagucgaagacugcgauuccacuuggcagacggacucugagccugaaccagaggaaccgggucccggcgggggaucagagggcccuggucaagagagugaacagccagcccagcccccugagcaggcugggggaaggccaggcgcaagccccgccccugaugaagacgcggaggcugccggcgcagagcaagggggagauuccaccgaagccacagcuaagccaaaacggucuuuuuacgcagcccgcgaccuuuauaaguaccgacaccaguauccgaauuucaaagauauccguuaccagaacgaccugucgaauuugagauuuuauaagaacaaaauucccuucaagccugaugguguuuacauagaggaaguguuaucaaaguggaaaggcgacuaugagaagcuggaacauaaucacacuuacauccaguggcuauuuccacucagggagcaagggcugaacuucuacgcuaaagagcuuaccacauaugaaauugaggaauuuaagaaaaccaaggaggccauccggcgcuuccuguuggcguacaagaugaugcucgaauuuuucggaauuaaacugacugauaagacaggcaauguagcaagagccgugaacuggcaggagagguuucagcaucugaaugagagccagcacaacuaucuccggaucacccgcauauuaaaaagucugggugaacuuggguacgaguccuucaagucucccuuggucaaauuuauccugcaugaagcucuaguggagaauacgauuccuaacaucaagcaaagcgcccucgaauauuucguuuacacuauucgagacagaagggagcggcguaaacugcuucgcuucgcacagaagcacuauaccccauccgagaauuuuaucuggggacccccgagaaaggaacagucagagggcaguaaagcucaaaagaugagcucuccucuggccuccucacacaacagccagacaaguaugcauaaaaaggcgaaagauucuaaaaauuccagcucggccgugcacuugaacucuaagacugcagaagacaagaaggucgcucccaaagagccaguggaggaaaccgacaggccuucccccgagccaucaaacgaagccgcuaagccccggaauacagagaaagauaguaacgccgaaaauaugaacagccagccugagaagaccguaacgacuccaacagagaagaaagaauccguuucuccggagaauaacgaagagggcgggaaugacaaccaggauaaugaaaaccccggaaauaccaacugucaugacgugguccucgugcaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 514 - RNA, 775 nt, Artificial Sequence
  mRNA product Design1 comprising derived and/or modified sequence from Homo sapiens__NP_008842.1__HsRLN1 (opt3)
gggagaaagcuuaccaugcccagacuguuccucuuucaccuucuggaguucugcuuguuacugaaccaguuuagcagggccguggcugcaaaguggaaagacgaugucaucaagcuauguggccgggaacucguucgcgcccaaauugcgauaugcgggauguccaccuggucuaaacgaucacugagucaggaggacgcuccucagacaccacguccgguggccgaaaucguacccagcuucauuaauaaggauacugagacgaucauuaucaugcuugaauuuauagcaaaccugccuccagaguugaaagccgcucucuccgagagacagcccucucugccugaacugcaacaguacgugccagcacucaaggacucgaauuuaucauucgaggaauuuaagaaacugaucaggaaccggcagagcgaggccgcugauaguaaucccuccgagcuuaaguauuugggacuggacacccauucucagaaaaagcgcagaccuuacgucgcccuauucgaaaaauguugccucauugguuguacaaagaggagccuggcgaaguauugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 515 - RNA, 775 nt, Artificial Sequence
  mRNA product Design1 comprising derived and/or modified sequence from Homo sapiens__NP_604390.1__HsRLN2 (opt3)
gggagaaagcuuaccaugcccagacuguucuuuuuccaccuccuuggcgugugccuguuguuaaaccaguuuagcagggccgucgcugacuccuggauggaggaaguuaucaagcugugugggcgggagcuagugcgcgcacaaauugccauaugcggaaugucuaccuggucaaaacgaagucucagccaggaagaugcgccucagacaccacguccgguagcugagaucgugcccuccuucauuaauaaggacacugaaacgaucaacaugaugucugaguuugucgccaaucugccucaggagcuuaaacugaccuugucggaaaugcaaccagcacucccccagcugcagcagcaugugccuguucugaaggauucaagccucuuauucgaggaauuuaaaaagcugauuagaaacaggcaaagugaggccgcugacuccucuccaagcgagcuuaaguacuugggucuggauacacacucccggaaaaagcgccagcuauauucagcacucgccaauaaauguugccaugugggcuguacuaagagaagucuggcuagguucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 516 - RNA, 646 nt, Artificial Sequence
  mRNA product Design1 comprising derived and/or modified sequence from Homo sapiens__NP_543140.1__HsRLN3  (opt3)
gggagaaagcuuaccauggccagauacaugcugcuccuucuguuggcugugugggucuuaaccggcgagcuguggcccggggcagaagccagggcggcuccuuauggaguucggcuaugcggucgcgaguucauccgagccgugauuuuuacauguggcgggagccguuggagaagguccgacauacucgcacacgaagccaugggagauacuuucccagacgcugaugcagacgaggauucucuggccggcgaacuugacgaggcuauggguucaagugaguggcuggccuugaccaagagcccgcaggcguuuuaccgggggcgccccuccuggcaaggaacgccuggcguacucagaggcucuagggaugugcuggcagggcugucgucaagcugcuguaaauggggaugcaguaaguccgaaaucucuagccucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 517 - RNA, 1627 nt, Artificial Sequence
  mRNA product Design1 comprising derived and/or modified sequence from Homo sapiens__NP_002412.1__HsMMP1 (opt3)
gggagaaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 518 - RNA, 1387 nt, Artificial Sequence
  mRNA product Design1 comprising derived and/or modified sequence from Homo sapiens__NP_002412.1__HsMMP1(1-19,100-469) (opt3)
gggagaaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 519 - RNA, 3574 nt, Artificial Sequence
  mRNA product Design1 comprising derived and/or modified sequence from Clostridium histolyticum__BAA77453.1__ColG (opt3)
gggagaaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 520 - RNA, 3298 nt, Artificial Sequence
  mRNA product Design1 comprising derived and/or modified sequence from Clostridium histolyticum__BAA77453.1__HsALB(1-18)_ColG(111-1118) (opt3)
gggagaaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 521 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt3)
gggagaaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 522 - RNA, 3322 nt, Artificial Sequence
  mRNA product Design1 comprising derived and/or modified sequence from Clostridium histolyticum__BAA34542.1__ColH (opt3)
gggagaaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 523 - RNA, 3283 nt, Artificial Sequence
  mRNA product Design1 comprising derived and/or modified sequence from Clostridium histolyticum__BAA34542.1__ColH (opt3)
gggagaaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 524 - RNA, 3217 nt, Artificial Sequence
  mRNA product Design1 comprising derived and/or modified sequence from Clostridium histolyticum__BAA34542.1__HsALB(1-18)_ColH(41-1021) (opt3)
gggagaaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 525 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt3)
gggagaaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 526 - RNA, 1063 nt, Artificial Sequence
  mRNA product Design1 comprising derived and/or modified sequence from Homo sapiens__NP_003801.1__HsTNFSF10 (opt4)
gggagaaagcuuaccauggccaugauggaggugcagggcggccccagccugggccagaccugcgugcugaucgugaucuucaccgugcugcugcagagccugugcguggccgugaccuacguguacuucaccaacgagcugaagcagaugcaggacaaguacagcaagagcggcaucgccugcuuccugaaggaggacgacagcuacugggaccccaacgacgaggagagcaugaacagccccugcuggcaggugaaguggcagcugagacagcuggugagaaagaugauccugagaaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 527 - RNA, 784 nt, Artificial Sequence
  mRNA product Design1 comprising derived and/or modified sequence from Homo sapiens__NP_003801.1__HsTNFSF10(95-281) (opt4)
gggagaaagcuuaccaugaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 528 - RNA, 835 nt, Artificial Sequence
  mRNA product Design1 comprising derived and/or modified sequence from Homo sapiens__NP_003801.1__HsALB(1-18)_HsTNFSF10(95-281) (opt4)
gggagaaagcuuaccaugaagugggugaccuucaucagccugcuguuccuguucagcagcgccuacagcaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 529 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt4)
gggagaaagcuuaccaugaagugggugaccuucaucagccugcuguuccuguucagcagcgccuacagcagaaugaagcagaucgaggacaagaucgaggagauccugagcaagaucuaccacaucgagaacgagaucgccagaaucaagaagcugaucggcgagaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 530 - RNA, 1294 nt, Artificial Sequence
  mRNA product Design1 comprising derived and/or modified sequence from Rattus norvegicus__NP_036656.1__RnCebpa (opt4)
gggagaaagcuuaccauggagagcgccgacuucuacgaggccgagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 531 - RNA, 1252 nt, Artificial Sequence
  mRNA product Design1 comprising derived and/or modified sequence from Rattus norvegicus__NP_036656.1__RnCebpa(15-344) (opt4)
gggagaaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 532 - RNA, 1297 nt, Artificial Sequence
  mRNA product Design1 comprising derived and/or modified sequence from Mus musculus__NP_031704.2 __MmCebpa (opt4)
gggagaaagcuuaccauggagagcgccgacuucuacgagguggagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 533 - RNA, 1255 nt, Artificial Sequence
  mRNA product Design1 comprising derived and/or modified sequence from Mus musculus__NP_031704.2 __MmCebpa(15-359) (opt4)
gggagaaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 534 - RNA, 1294 nt, Artificial Sequence
  mRNA product Design1 comprising derived and/or modified sequence from Homo sapiens__NP_004355.2__HsCEBPA (opt4)
gggagaaagcuuaccauggagagcgccgacuucuacgaggccgagcccagaccccccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 535 - RNA, 1252 nt, Artificial Sequence
  mRNA product Design1 comprising derived and/or modified sequence from Homo sapiens__NP_004355.2__HsCEBPA(15-358) (opt4)
gggagaaagcuuaccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 536 - RNA, 1642 nt, Artificial Sequence
  mRNA product Design1 comprising derived and/or modified sequence from Homo sapiens__NP_000448.3__HsHNF4A (opt4)
gggagaaagcuuaccaugagacugagcaagacccugguggacauggacauggccgacuacagcgccgcccuggaccccgccuacaccacccuggaguucgagaacgugcaggugcugaccaugggcaacgacaccagccccagcgagggcaccaaccugaacgcccccaacagccugggcgugagcgcccugugcgccaucugcggcgacagagccaccggcaagcacuacggcgccagcagcugcgacggcugcaagggcuucuucagaagaagcgugagaaagaaccacauguacagcugcagauucagcagacagugcgugguggacaaggacaagagaaaccagugcagauacugcagacugaagaagugcuucagagccggcaugaagaaggaggccgugcagaacgagagagacagaaucagcaccagaagaagcagcuacgaggacagcagccugcccagcaucaacgcccugcugcaggccgaggugcugagcagacagaucaccagccccgugagcggcaucaacggcgacaucagagccaagaagaucgccagcaucgccgacgugugcgagagcaugaaggagcagcugcuggugcugguggagugggccaaguacauccccgccuucugcgagcugccccuggacgaccagguggcccugcugagagcccacgccggcgagcaccugcugcugggcgccaccaagagaagcaugguguucaaggacgugcugcugcugggcaacgacuacaucgugcccagacacugccccgagcuggccgagaugagcagagugagcaucagaauccuggacgagcuggugcugcccuuccaggagcugcagaucgacgacaacgaguacgccuaccugaaggccaucaucuucuucgaccccgacgccaagggccugagcgaccccggcaagaucaagagacugagaagccaggugcaggugagccuggaggacuacaucaacgacagacaguacgacagcagaggcagauucggcgagcugcugcugcugcugcccacccugcagagcaucaccuggcagaugaucgagcagauccaguucaucaagcuguucggcauggccaagaucgacaaccugcugcaggagaugcugcugggcggcagccccagcgacgccccccacgcccaccacccccugcacccccaccugaugcaggagcacaugggcaccaacgugaucguggccaacaccaugcccacccaccugagcaacggccagaugugcgaguggcccagacccagaggccaggccgccacccccgagaccccccagcccagcccccccggcggcagcggcagcgagcccuacaagcugcugcccggcgccguggccaccaucgugaagccccugagcgccaucccccagcccaccaucaccaagcaggaggugaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 537 - RNA, 847 nt, Artificial Sequence
  mRNA product Design1 comprising derived and/or modified sequence from Homo sapiens__NP_061986.1__HsFGF21 (opt4)
gggagaaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 538 - RNA, 1573 nt, Artificial Sequence
  mRNA product Design1 comprising derived and/or modified sequence from Homo sapiens__NP_078852.3__HsOGFRL1 (opt4)
gggagaaagcuuaccaugggcaaccugcugggcggcgugagcuucagagagcccaccaccguggaggacugcgacagcaccuggcagaccgacagcgagcccgagcccgaggagcccggccccggcggcggcagcgagggccccggccaggagagcgagcagcccgcccagccccccgagcaggccggcggcagacccggcgccagccccgcccccgacgaggacgccgaggccgccggcgccgagcagggcggcgacagcaccgaggccaccgccaagcccaagagaagcuucuacgccgccagagaccuguacaaguacagacaccaguaccccaacuucaaggacaucagauaccagaacgaccugagcaaccugagauucuacaagaacaagauccccuucaagcccgacggcguguacaucgaggaggugcugagcaaguggaagggcgacuacgagaagcuggagcacaaccacaccuacauccaguggcuguucccccugagagagcagggccugaacuucuacgccaaggagcugaccaccuacgagaucgaggaguucaagaagaccaaggaggccaucagaagauuccugcuggccuacaagaugaugcuggaguucuucggcaucaagcugaccgacaagaccggcaacguggccagagccgugaacuggcaggagagauuccagcaccugaacgagagccagcacaacuaccugagaaucaccagaauccugaagagccugggcgagcugggcuacgagagcuucaagagcccccuggugaaguucauccugcacgaggcccugguggagaacaccauccccaacaucaagcagagcgcccuggaguacuucguguacaccaucagagacagaagagagagaagaaagcugcugagauucgcccagaagcacuacacccccagcgagaacuucaucuggggcccccccagaaaggagcagagcgagggcagcaaggcccagaagaugagcagcccccuggccagcagccacaacagccagaccagcaugcacaagaaggccaaggacagcaagaacagcagcagcgccgugcaccugaacagcaagaccgccgaggacaagaagguggcccccaaggagcccguggaggagaccgacagacccagccccgagcccagcaacgaggccgccaagcccagaaacaccgagaaggacagcaacgccgagaacaugaacagccagcccgagaagaccgugaccacccccaccgagaagaaggagagcgugagccccgagaacaacgaggagggcggcaacgacaaccaggacaacgagaaccccggcaacaccaacugccacgacguggugcuggugcagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 539 - RNA, 775 nt, Artificial Sequence
  mRNA product Design1 comprising derived and/or modified sequence from Homo sapiens__NP_008842.1__HsRLN1 (opt4)
gggagaaagcuuaccaugcccagacuguuccuguuccaccugcuggaguucugccugcugcugaaccaguucagcagagccguggccgccaaguggaaggacgacgugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaucaucaugcuggaguucaucgccaaccugccccccgagcugaaggccgcccugagcgagagacagcccagccugcccgagcugcagcaguacgugcccgcccugaaggacagcaaccugagcuucgaggaguucaagaagcugaucagaaacagacagagcgaggccgccgacagcaaccccagcgagcugaaguaccugggccuggacacccacagccagaagaagagaagacccuacguggcccuguucgagaagugcugccugaucggcugcaccaagagaagccuggccaaguacugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 540 - RNA, 775 nt, Artificial Sequence
  mRNA product Design1 comprising derived and/or modified sequence from Homo sapiens__NP_604390.1__HsRLN2 (opt4)
gggagaaagcuuaccaugcccagacuguucuucuuccaccugcugggcgugugccugcugcugaaccaguucagcagagccguggccgacagcuggauggaggaggugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugaucagaaacagacagagcgaggccgccgacagcagccccagcgagcugaaguaccugggccuggacacccacagcagaaagaagagacagcuguacagcgcccuggccaacaagugcugccacgugggcugcaccaagagaagccuggccagauucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 541 - RNA, 646 nt, Artificial Sequence
  mRNA product Design1 comprising derived and/or modified sequence from Homo sapiens__NP_543140.1__HsRLN3  (opt4)
gggagaaagcuuaccauggccagauacaugcugcugcugcugcuggccgugugggugcugaccggcgagcuguggcccggcgccgaggccagagccgcccccuacggcgugagacugugcggcagagaguucaucagagccgugaucuucaccugcggcggcagcagauggagaagaagcgacauccuggcccacgaggccaugggcgacaccuuccccgacgccgacgccgacgaggacagccuggccggcgagcuggacgaggccaugggcagcagcgaguggcuggcccugaccaagagcccccaggccuucuacagaggcagacccagcuggcagggcacccccggcgugcugagaggcagcagagacgugcuggccggccugagcagcagcugcugcaaguggggcugcagcaagagcgagaucagcagccugugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 542 - RNA, 1627 nt, Artificial Sequence
  mRNA product Design1 comprising derived and/or modified sequence from Homo sapiens__NP_002412.1__HsMMP1 (opt4)
gggagaaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 543 - RNA, 1387 nt, Artificial Sequence
  mRNA product Design1 comprising derived and/or modified sequence from Homo sapiens__NP_002412.1__HsMMP1(1-19,100-469) (opt4)
gggagaaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 544 - RNA, 3574 nt, Artificial Sequence
  mRNA product Design1 comprising derived and/or modified sequence from Clostridium histolyticum__BAA77453.1__ColG (opt4)
gggagaaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 545 - RNA, 3298 nt, Artificial Sequence
  mRNA product Design1 comprising derived and/or modified sequence from Clostridium histolyticum__BAA77453.1__HsALB(1-18)_ColG(111-1118) (opt4)
gggagaaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 546 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt4)
gggagaaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 547 - RNA, 3322 nt, Artificial Sequence
  mRNA product Design1 comprising derived and/or modified sequence from Clostridium histolyticum__BAA34542.1__ColH (opt4)
gggagaaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 548 - RNA, 3283 nt, Artificial Sequence
  mRNA product Design1 comprising derived and/or modified sequence from Clostridium histolyticum__BAA34542.1__ColH (opt4)
gggagaaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 549 - RNA, 3217 nt, Artificial Sequence
  mRNA product Design1 comprising derived and/or modified sequence from Clostridium histolyticum__BAA34542.1__HsALB(1-18)_ColH(41-1021) (opt4)
gggagaaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 550 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt4)
gggagaaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 551 - RNA, 1063 nt, Artificial Sequence
  mRNA product Design1 comprising derived and/or modified sequence from Homo sapiens__NP_003801.1__HsTNFSF10 (opt5)
gggagaaagcuuaccauggccaugauggaggugcagggcgggcccagccugggacaaaccugcguccucaucguuauuuucacagugcugcuucagucccuguguguggcugucacguacguguauuuuaccaacgaacucaagcagaugcaggacaaauacucuaagagcggcaucgccugcuuccugaaagaggaugacuccuauugggauccuaaugacgaagagucuaugaacagcccguguuggcaaguuaaguggcagcuuagacagcuggugcggaaaaugauucuccgcacauccgaagagaccaucucuacaguccaggagaagcaacagaauauuagcccccuggugagagaacgggggccucagcgcguugcggcucacaucaccggaacaagaggccgguccaacacccugagcucucccaauuccaagaacgagaaagcccucgggcgcaagaucaauagcugggaaucuuccagaagcggacauucuuuucuguccaaccuucaucugcggaauggcgagcucgugauucacgagaaaggcuucuacuauaucuacagccagacguauuuucgcuuccaagaagagauuaaggaaaacaccaaaaaugauaagcagaugguccaguacaucuacaaguauacauccuacccugaccccauucugcuuaugaaaucugccagaaacagcugcugguccaaggaugcugaguaugggcuguacagcaucuaucaaggaggcauuuuugaacucaaagagaaugaccggaucuucgugucugugaccaacgagcaccugaucgauauggaccaugaagccuccuuuuucggggcuuuucuggucggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 552 - RNA, 784 nt, Artificial Sequence
  mRNA product Design1 comprising derived and/or modified sequence from Homo sapiens__NP_003801.1__HsTNFSF10(95-281) (opt5)
gggagaaagcuuaccaugaccagcgaggaaacaaucuccacggugcaggagaagcaacagaacauuucuccccuggucagagaacggggcccucagcgcguugccgcucacaucaccgggacaagaggacggagcaauacccucuccucuccgaacagcaaaaaugagaaggcccugggccgcaaaauuaacuccugggaaucuagcagauccgggcauagcuuccuuucuaaucugcaccuccggaacggagagcuggugauccaugagaagggcuuuuacuauauuuacucccagacauauuuccgcuuucaagaagagaucaaagaaaauaccaagaacgacaagcagauggugcaguacaucuauaaauacacaagcuaucccgauccuauucuucugaugaagucugcgagaaauuccugcuggagcaaagacgcugaguacgggcucuacucuaucuaucagggaggcauuuucgagcugaaggaaaacgaucggaucuuugucuccgugaccaaugagcaccugauugacauggaucaugaagccagcuucuuuggcgccuuccucguugggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 553 - RNA, 835 nt, Artificial Sequence
  mRNA product Design1 comprising derived and/or modified sequence from Homo sapiens__NP_003801.1__HsALB(1-18)_HsTNFSF10(95-281) (opt5)
gggagaaagcuuaccaugaagugggugaccuucaucagccugcucuuucuguucuccucugccuacagcacauccgaggaaacgauuucuaccguccaggagaaacaacagaacaucagcccccuuguuagagaacggggcccucagcgcguggcugcccacauuacagggaccagaggacgguccaauacacugucuagcccgaacuccaagaaugagaaagcgcucggccgcaagaucaacagcugggaaucuuccagaagcgggcauucuuuucuguccaaucuucaucugcggaacggagagcucgugauucacgagaaaggcuucuauuacaucuauagccagaccuacuuucgcuuccaagaagagaucaaggaaaauacaaagaacgacaaacagaugguccaguauauuuacaaguauaccucuuaccccgauccuauccugcugaugaaauccgcuagaaauagcugcugguccaaggacgccgaguacgggcucuauucuauuuaccagggaggcaucuuugagcugaaagaaaacgaucggauuuucgugagcguuacgaaugagcaccuuaucgacauggaucaugaagccuccuuuuucggcgcuuuucugguggggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 554 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt5)
gggagaaagcuuaccaugaagugggugaccuucaucagccugcucuuucuguucuccucugccuacagcagaaugaaacagauugaggacaagaucgaagagauucuuuccaaaaucuaucacauugaaaacgagaucgcucggaucaagaaacugauuggcgaaacaucugaggagacgaucagcaccguccaagaaaagcagcagaauauuucuccccucguucgcgagagagggccucagcggguggccgcgcauaucacaggaacccgcggcagauccaacacacugagcuccccgaauagcaagaacgaaaaagcucuugggcggaagauuaauucuugggaguccagccgcucuggacacuccuuucugagcaaccuccaucugagaaauggcgagcuggugauccacgaaaaaggguucuacuauauuuacucucaaaccuauuuucgguuccaggaggaaaucaaggagaacaccaaaaaugauaagcagaugguccaguacaucuauaaguacacauccuaccccgacccuauucuccugaugaaaagcgcccgcaacuccugcuggucuaaggaugccgaauauggacuuuacagcaucuaucaaggcggcauuuuugagcugaaagagaaugacagaaucuucguguccguuacgaacgaacaucucauugauauggaccacgaggcuagcuuuuucggggccuuucuggugggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 555 - RNA, 1294 nt, Artificial Sequence
  mRNA product Design1 comprising derived and/or modified sequence from Rattus norvegicus__NP_036656.1__RnCebpa (opt5)
gggagaaagcuuaccauggagagcgccgacuucuacgaagcugagcccagaccuccgauguccucucaucugcagagcccuccccacgcccccuccaacgcggcuuuuggcuucccucgcggggccggacccgccccuccgcccgcuccucccgccgcuccugaaccccucggcgggaucugcgagcacgaaaccucuauugauaucagcgccuauauugacccggcggccuuuaaugaugaguuccuggcugaccuuuuucaacauucccggcagcaggagaaggccaaagcugccgcgggaccugccggcgggggaggcgauuucgacuaccccggcgcuccugccgggcccggaggcgcugugaugucugccggggcccacggacccccuccgggcuaugggugugcugcggccggauaccuggauggcagacucgaaccccuguaugagcgggucggcgcuccugcccuucgcccccugguuaucaagcaggaaccuagagaggaggacgaagccaaacaacucgcucuggccgggcuguuucccuaccagccgccucccccucccccucccccgcauccucacgcgagccccgcucaccucgccgcuccccaucugcaguuccagauugcccacugcggacaaacaacgaugcaucuucagccuggccacccgacacccccucccaccccugugcccuccccucaccccgccccggcuaugggggccgcgggacugccuggccccgggggaagccucaagggccuggccggcccucaucccgaucuucggaccgggggaggcgggggaggcggggcuggcgccggaaaagcuaagaagucuguggacaaaaacuccaaugaguaucgcgucagacgggaacgcaacaauaucgccgugagaaagagccgggauaaagcgaagcagcgcaacguugagacacagcaaaaagugcuggaacucaccucugacaaugauagacugcggaagcgcgucgagcagcuguccagagagcucgacacacugcggggcaucuuuagacagcuuccggaaagcucucuggugaaggccauggggaacugugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 556 - RNA, 1252 nt, Artificial Sequence
  mRNA product Design1 comprising derived and/or modified sequence from Rattus norvegicus__NP_036656.1__RnCebpa(15-344) (opt5)
gggagaaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacccugcccccgcuaugggggccgcuggacugccuggccccgggggaucccucaagggccuggccggcccgcauccugaccuuagaaccgggggaggcgggggaggcggggcgggcgccggaaaagcuaaaaagagcguggauaagaacucuaaugaguaccggguccgcagagagcggaacaauaucgccgugcgcaaguccagagacaaagcuaagcagcggaacguugaaacacagcaaaaagugcuggagcucaccagcgauaaugaccgccugagaaagcgggucgaacagcugucucgcgagcucgauacacugagaggcaucuuccggcagcuucccgaauccagccuggugaaggccauggggaacugugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 557 - RNA, 1297 nt, Artificial Sequence
  mRNA product Design1 comprising derived and/or modified sequence from Mus musculus__NP_031704.2 __MmCebpa (opt5)
gggagaaagcuuaccauggagagcgccgacuucuacgaaguggagcccagaccuccgauguccucucaucugcagagcccuccccacgcucccuccaacgccgcguuuggcuucccucgcggggcuggacccgccccuccgcccgccccucccgcugccccugaaccccucggcgggaucugcgagcacgaaaccucuauugauaucagcgcuuauauugacccggccgcguuuaaugaugaguuccuggccgaccuuuuucaacauucccggcagcaggagaaggcuaaagccgcugccggaccugcgggcgggggaggcgauuucgacuaccccggcgccccugcugggcccggaggcgccgucaugucugcuggggcccacggacccccuccgggcuaugggugugccgcugcgggauaccuggauggcagacucgaaccccuguaugagcggguuggcgccccugcccuucgcccccuggugaucaagcaggaaccuagagaggaggacgaagccaaacaacucgcccuggcugggcuguuucccuaccagccgccucccccucccccucccccgcauccucacgccagccccgcgcaccucgcugcuccccaucugcaguuccagauugcccacugcggacaaacaacgaugcaucuucagccuggccacccgacacccccucccaccccugugcccuccccucacgcugcccccgcucugggggccgcgggacucccgggcccugggagcgcccugaagggacuugcuggcgcccaucccgaucugcggaccggcgggggaggcgggggaucuggcgcuggggccggcaaagcgaagaaguccgucgacaaaaacagcaaugaguaucgcgugagacgggaacgcaacaauaucgccguuagaaagucucgggauaaagcuaagcagcgcaacguggagacacagcaaaaaguccucgaacugaccuccgacaaugauagacugcggaagcgcguggagcagcucagcagagagcuggacacacuucggggaaucuuuagacagcugccugaaucuucccucguuaaggccaugggcaacugugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 558 - RNA, 1255 nt, Artificial Sequence
  mRNA product Design1 comprising derived and/or modified sequence from Mus musculus__NP_031704.2 __MmCebpa(15-359) (opt5)
gggagaaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacgccgcuccugcccugggggcugccggacuccccggcccuggguccgcgcugaagggacuugccggcgcucaucccgaccugagaaccggcgggggaggcgggggaagcggcgccggggcuggcaaagccaagaagucuguggauaaaaacuccaaugaguaccggguccgcagagagcggaacaauaucgcggugcgcaagagcagagacaaagccaagcagcggaacguugaaacacagcaaaaagugcucgagcugaccucugauaaugaccgccugagaaagcgggucgaacagcucucccgcgagcuggauacacuuagaggaaucuuccggcagcugccggaaagcucucucgugaaggcuaugggcaacugugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 559 - RNA, 1294 nt, Artificial Sequence
  mRNA product Design1 comprising derived and/or modified sequence from Homo sapiens__NP_004355.2__HsCEBPA (opt5)
gggagaaagcuuaccauggagagcgccgacuucuacgaagcugagcccagaccuccgauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 560 - RNA, 1252 nt, Artificial Sequence
  mRNA product Design1 comprising derived and/or modified sequence from Homo sapiens__NP_004355.2__HsCEBPA(15-358) (opt5)
gggagaaagcuuaccauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 561 - RNA, 1642 nt, Artificial Sequence
  mRNA product Design1 comprising derived and/or modified sequence from Homo sapiens__NP_000448.3__HsHNF4A (opt5)
gggagaaagcuuaccaugagacugagcaagacccucguggacauggauauggccgacuacuccgcugcccuggaucccgcguauacaacgcuugaguucgaaaacguccagguucugaccaugggcaaugacacaucuccuagcgaggggaccaaccucaaugcuccgaacucccugggagugucugcccuuugcgccaucuguggcgaucgggcuacagggaaacacuacggagccagcuccugcgacggcuguaagggguuuuuccgcagaucugugcggaaaaaucauauguauagcugccgcuuuuccagacaaugugucguggauaaggacaaacggaaccagugccgcuacuguagacugaagaagugcuuccgggcuggaaugaaaaaggaagccguucagaaugagcgcgauagaauuagcacccggcgcagcuccuaugaagacagcucucuccccuccaucaacgcgcugcugcaggccgaggugcucagcagacaaauuacaucuccugucuccggcaucaauggcgauauucgggcuaaaaagaucgccagcaucgcugacgugugugaguccaugaaagaacagcugcuuguucugguggagugggccaaguacauucccgcguuuugcgaacucccucuggaugaccaggucgcccuucugcgcgcucacgccggggagcaucuccugcugggagcuaccaagagaucuaugguguucaaagacgugcuccugcuuggcaacgauuauaucgucccccggcacuguccugagcuggccgaaaugagcagaguuuccauucgcauccucgacgagcuggugcuuccguuucaggaacugcaaauugaugacaaugaguacgccuaccucaaggcuaucauuuucuuugaucccgacgcgaaagggcugagcgauccuggaaagaucaaacggcugagaucucaggugcaggucucccucgaagacuauaucaacgaucgccaguacgacagccggggcagauucggggagcugcuucugcuccugcccacgcuucaaucuauuaccuggcagaugaucgagcagauucaauuuaucaagcuguucggaauggccaaaauugauaaucuccugcaggaaaugcugcucggcggcagcccuuccgacgcuccccaugcccaccacccgcugcauccucaccuuaugcaggagcauauggggacaaacgugaucguugccaauaccaugcccacacaccugucuaacggacagaugugcgaauggccucgcccccggggccaagcugccacccccgagacgccucagccgucucccccugggggauccggcagcgaacccuauaagcuccugccuggggcgguggcuacaaucgucaagccccugucugccauuccgcagccuaccaucacaaaacaggaggugauuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 562 - RNA, 847 nt, Artificial Sequence
  mRNA product Design1 comprising derived and/or modified sequence from Homo sapiens__NP_061986.1__HsFGF21 (opt5)
gggagaaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 563 - RNA, 1573 nt, Artificial Sequence
  mRNA product Design1 comprising derived and/or modified sequence from Homo sapiens__NP_078852.3__HsOGFRL1 (opt5)
gggagaaagcuuaccaugggcaaccugcucgggggagugagcuucagagagcccaccacagucgaagacugcgauuccacguggcagaccgacucugagccugaaccggaggaacccggcccugggggaggcagcgaggggcccggacaagaguccgaacagccugcccagcccccugagcaggcuggcggccggccgggggccucucccgcgccugaugaagacgcugaggccgccggagcugagcaaggcggggauagcacagaagccaccgcuaagcccaaacgcuccuuuuacgccgcgagagaccuguauaaguaccggcaccaguauccuaauuucaaagauauccgcuaccagaacgaccuuucuaaucugagauuuuauaagaacaaaauucccuucaagccggauggaguuuacaucgaggaagugcucagcaaguggaaaggcgacuaugagaagcuggaacauaaucacacauacauucaguggcuuuuuccucugcgggagcaagggcucaacuucuacgccaaagagcugaccacauaugaaaucgaggaauuuaagaaaaccaaggaggcuauucgcagauuccugcucgccuacaagaugaugcuggaauuuuucggaaucaaacuuacggauaagaccggcaauguggcucgggccgucaacuggcaggagcgcuuucagcaucugaaugagucccagcacaacuaucucagaaucacacggauucugaaaagccuuggcgaacugggguacgagucuuucaagucuccccucgugaaauuuauccugcaugaagcgcugguugagaauaccauuccuaacaucaagcaaagcgcccucgaauauuucguguacacaauucgcgacagacgggagcgcagaaaacugcuucgguucgcucagaagcacuauacccccucugagaauuuuaucuggggacccccuagaaaggaacaguccgagggcagcaaagcccaaaagaugucuuccccgcuggcuagcucccacaacucucagacgagcaugcauaaaaaggccaaagauuccaagaauagcuccuccgccguccaccucaacagcaagacagcugaagacaaaaagguggcgcccaaagagccuguugaggaaaccgaccgccccucuccugagcccagcaacgaagccgcuaagccgcggaauacagagaaagauuccaacgccgaaaauaugaacucucagccugagaagaccgugaccacacccacggagaagaaagaaagcgucuccccugagaauaacgaagaagggggaaaugacaaccaggauaaugagaaccccggcaauaccaacugucaugacguggugcugguccaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 564 - RNA, 775 nt, Artificial Sequence
  mRNA product Design1 comprising derived and/or modified sequence from Homo sapiens__NP_008842.1__HsRLN1 (opt5)
gggagaaagcuuaccaugcccagacuguuccucuuucaccuucuugaguucugccugcuccugaaccaguuuagccgggccguggcugccaaguggaaagacgaugucaucaagcuguguggccgcgaacugguuagagcgcaaauugcuaucugcgggauguccaccuggucuaaacggagccucucccaggaggacgccccucagacaccgcgccccguggccgaaauugugccuucuuucaucaauaaggauacggagaccauuaucaucaugcuggaauuuauugcuaaccugcccccugagcucaaagccgcucugagcgagagacagcccucccuuccugaacugcaacaguacgucccggcccucaaggacucuaaucugagcuucgaggaauuuaagaaacuuauccggaaccgccaguccgaggcggccgauagcaaucccucugagcugaaguaucucggacuggacacacauucccagaaaaagagacggccuuacguggcucuguucgaaaaauguugccucauuggcuguaccaagcgcagccuggccaaguauugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 565 - RNA, 775 nt, Artificial Sequence
  mRNA product Design1 comprising derived and/or modified sequence from Homo sapiens__NP_604390.1__HsRLN2 (opt5)
gggagaaagcuuaccaugcccagacuguucuuuuuccaccuccugggcgugugccuucugcucaaccaguuuagccgggccgucgcugacuccuggauggaggaaguuaucaagcugugugggcgcgagcuugugagagcccaaauugcgaucugcggaaugucuaccuggagcaaacggucccugucucaggaagaugcuccucagacaccgcgccccguggccgagauugucccuagcuucaucaauaaggacacggaaaccauuaacaugauguccgaguuuguggccaaucucccccaggagcugaaacugacacucucugaaaugcaaccugcucugccccagcuucagcagcauguuccugugcugaaggauagcucccuccuguucgaggaauuuaaaaagcugaucagaaaccggcaaagcgaggccgcugacucuuccccgagcgagcuuaaguaccucggccuggauacccacucucgcaaaaagagacagcuguauuccgcccucgcgaauaaauguugccaugucggguguacaaagcggagccuggcccgcuucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 566 - RNA, 646 nt, Artificial Sequence
  mRNA product Design1 comprising derived and/or modified sequence from Homo sapiens__NP_543140.1__HsRLN3  (opt5)
gggagaaagcuuaccauggccagauacaugcugcuccugcuucuggcuguguggguccucaccggcgagcuguggcccggggccgaagcgcgggcugccccuuauggaguucgccuuugcggcagagaguucauccgggccgugauuuuuacaugugggggaagccgcuggagacgguccgacauccuggcucacgaagccaugggcgauacguucccggacgcugaugccgacgaggauucucucgcgggggaacuggacgaggccaugggaagcuccgaguggcuggcucucaccaagucuccccaggccuuuuaccgcggcagaccuagcuggcaaggcacacccggggugcugcggggaucccgcgauguccuugcuggccugucuagcuccugcuguaaaugggggugcagcaagucugaaauuuccagccucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 567 - RNA, 1627 nt, Artificial Sequence
  mRNA product Design1 comprising derived and/or modified sequence from Homo sapiens__NP_002412.1__HsMMP1 (opt5)
gggagaaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 568 - RNA, 1387 nt, Artificial Sequence
  mRNA product Design1 comprising derived and/or modified sequence from Homo sapiens__NP_002412.1__HsMMP1(1-19,100-469) (opt5)
gggagaaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 569 - RNA, 3574 nt, Artificial Sequence
  mRNA product Design1 comprising derived and/or modified sequence from Clostridium histolyticum__BAA77453.1__ColG (opt5)
gggagaaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 570 - RNA, 3298 nt, Artificial Sequence
  mRNA product Design1 comprising derived and/or modified sequence from Clostridium histolyticum__BAA77453.1__HsALB(1-18)_ColG(111-1118) (opt5)
gggagaaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 571 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt5)
gggagaaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 572 - RNA, 3322 nt, Artificial Sequence
  mRNA product Design1 comprising derived and/or modified sequence from Clostridium histolyticum__BAA34542.1__ColH (opt5)
gggagaaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 573 - RNA, 3283 nt, Artificial Sequence
  mRNA product Design1 comprising derived and/or modified sequence from Clostridium histolyticum__BAA34542.1__ColH (opt5)
gggagaaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 574 - RNA, 3217 nt, Artificial Sequence
  mRNA product Design1 comprising derived and/or modified sequence from Clostridium histolyticum__BAA34542.1__HsALB(1-18)_ColH(41-1021) (opt5)
gggagaaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 575 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt5)
gggagaaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 576 - RNA, 1063 nt, Artificial Sequence
  mRNA product Design1 comprising derived and/or modified sequence from Homo sapiens__NP_003801.1__HsTNFSF10 (opt6)
gggagaaagcuuaccauggcaaugauggaaguacaaggaggaccaucacuaggacaaacaugcguacuaauaguaauauucacaguacuacuccaaucacuaugugucgcagucacauacguauacuucacaaacgaauuaaaacaaaugcaagauaaauacucaaaaucaggaauagcuugcuucuuaaaagaagacgacucauacugggaccccaacgacgaagaaucaaugaauagcccaugcuggcaaguaaaauggcaacuaagacaauuaguaagaaaaaugauacuaagaacaucagaagaaacaauaucaacaguacaagaaaaacaacaaaacauaucaccccuaguaagagaaagaggaccacaaagaguagcagcacacauaacaggaacaagaggaagaagcaacacacuaucaaguccaaacagcaaaaacgaaaaagcacucggaagaaaaauaaacucaugggaauccagcagaagcggacacucauucuuaucaaaccuacauuuacgaaauggagaauuaguaauacacgaaaaaggauucuacuacauauacucacaaaccuacuucagauuccaagaagaaauaaaagaaaacaccaaaaacgacaaacaaaugguacaauacauauacaaauacacaucauauccagacccaauacuauuaaugaaaucagcaagaaauagcugcuggucaaaagacgcagaauacggacuauacucaauauaccaaggcggaauauucgaauuaaaagaaaacgacagaauauucguaucaguaacaaacgaacaccuaauagacauggaccacgaagcaaguuucuucggugcauucuuaguaggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 577 - RNA, 784 nt, Artificial Sequence
  mRNA product Design1 comprising derived and/or modified sequence from Homo sapiens__NP_003801.1__HsTNFSF10(95-281) (opt6)
gggagaaagcuuaccaugacaagcgaagaaacaauaagcacaguacaagaaaaacaacaaaacauaagcccccuaguaagagaaagaggaccacaacgaguagcagcacacauaacaggaacaagaggaagaucaaacacacuaagcucaccaaacaguaaaaacgaaaaagcauuaggaagaaaaauaaacucaugggaaucaagcagaagcggacacucauucuuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaaguuacccagacccaauacuacuaaugaaaucagcaagaaacagcugcuggucaaaagacgccgaauacggacuauacucaauauaccaaggaggaauauucgaacuaaaagaaaacgacagaauauucgucucaguaacaaacgaacacuuaauagacauggaccacgaagcaucauucuucggagcauuccuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 578 - RNA, 835 nt, Artificial Sequence
  mRNA product Design1 comprising derived and/or modified sequence from Homo sapiens__NP_003801.1__HsALB(1-18)_HsTNFSF10(95-281) (opt6)
gggagaaagcuuaccaugaaauggguaacauucauauccuuacuauuccuauucucaucagcauacucaacaucagaagaaacaauaucaacaguacaagaaaaacaacaaaacauauccccacuuguaagagaacgaggaccacaaagaguagcagcacacauaacaggaacaagaggaagauccaacacacuaucauccccaaacucaaaaaacgaaaaagcacuaggaagaaaaauaaacucaugggaaucauccagaucaggacacagcuuccuaucaaacuuacacuuaagaaacggagaacuuguaauacacgaaaaaggauucuacuacauauacucacaaacauacuucagauuccaagaagaaauaaaagaaaacacaaaaaacgacaaacaaaugguacaauacauauacaaauauacaucauacccagacccaauacuacuaaugaaaucagcaagaaacucaugcuggucaaaagacgcagaauacggacuauacagcauauaccaaggaggaauauucgaacuaaaagaaaacgacagaauauucguaucaguaacaaacgaacacuuaauagacauggaccacgaagcauccuucuucggagccuuccuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 579 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt6)
gggagaaagcuuaccaugaaauggguaacauucauaucacucuuauucuuauucucaagcgcauacucaagaaugaaacaaauagaagacaaaauagaagaaauauuaucaaaaauauaccauaucgaaaacgaaauagcaagaauaaaaaaauuaauaggagaaacaucagaagaaacaauaagcacgguacaagaaaaacaacaaaacauaagcccacuuguaagagaaagaggaccacaaagaguagcagcacacauaaccggaacaagaggcagaagcaauacacuaucaucaccaaauagcaaaaacgaaaaagcacuaggaagaaaaauaaacaguugggaaucaagcagaagcggacacucauuccuaagcaaccuacaccuaaggaacggagaauuaguaauacacgaaaaaggauuuuacuacauauacucacaaacauacuucagauuccaagaagaaauaaaagaaaacacaaaaaacgacaaacaaaugguacaauacauauacaaauacacaagcuauccagacccaauacuacuaaugaaaagugcaagaaauagcugcuggucaaaagacgccgaauacggacuauacagcauauaccaaggaggaauauucgaauuaaaagaaaacgaccgaauauuuguaaguguaacaaacgaacaccuaauagacauggaccacgaagcuagcuucuucggagcauuccuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 580 - RNA, 1294 nt, Artificial Sequence
  mRNA product Design1 comprising derived and/or modified sequence from Rattus norvegicus__NP_036656.1__RnCebpa (opt6)
gggagaaagcuuaccauggaaucagcugacuuuuaugaagcagaaccaagaccaccaaugucuucacaucuacaaaguccuccacaugcaccaucuaaugcagcuuuuggauuuccaagaggagcaggaccugcaccaccaccagcaccuccagcagcucccgaaccccuaggagguauaugugaacaugaaacaaguauagauauaagugcauacauagauccagcagcauuuaacgacgaauuuuuagcugaccuauuucaacauuccagacaacaagaaaaagcaaaagcugcagccggaccagcaggaggaggaggugauuucgacuauccaggagcaccagcaggaccuggcggagcaguaaugucagcaggagcacauggaccaccaccuggauacggaugugcagcagcuggauauuuagacggaagauuagaaccauuauaugaaagaguaggagcaccagcauuacguccauuaguaauaaaacaagaaccaagagaagaagacgaagcaaaacaacuagcacuugcagguuuauuuccauaucaaccaccuccuccaccaccaccaccacacccacacgccucaccagcacauuuagcagcaccucaucuacaauuucaaauagcacauuguggacaaacgacuaugcaucuacaaccaggacauccaacaccaccaccaacaccaguuccaucaccucauccagcacccgcuaugggagcagcaggccuaccaggaccaggagguucgcuaaaaggacucgcaggaccccauccagauuuaagaacaggagguggaggaggaggaggagcaggagcuggaaaagcaaaaaaaucaguagauaaaaacucaaacgaauacagagucagaagagaaagaaauaauauagcuguaagaaaaucaagagacaaagcaaaacaaagaaauguagaaacacaacaaaaaguacuugaauuaacaucugacaaugauagauuaagaaaaagaguagaacaauuaucaagagaacuagacacacuaagaggaauauuuagacaacuaccagaaucaagcuuaguuaaagccauggguaauugugcuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 581 - RNA, 1252 nt, Artificial Sequence
  mRNA product Design1 comprising derived and/or modified sequence from Rattus norvegicus__NP_036656.1__RnCebpa(15-344) (opt6)
gggagaaagcuuaccaugaguucacauuuacaaagccccccucaugcaccaucaaaugcagcauuuggauucccaagaggugcaggaccagcaccuccaccagcaccaccagcugcaccagaaccucuaggaggaauaugugaacaugaaacaucuauagauauaucagcauauauagauccugcagcauucaaugaugaauuuuuagcagauuuauuucaacacucaagacaacaagaaaaagcaaaagcagcagcuggaccagcagguggaggaggagacuuugauuauccaggagcaccagcagguccuggcggagcaguaaugucagcaggagcacauggacccccuccuggauauggaugugcagcagcuggauauuuagacggaagauuagaaccauuauacgaaagaguaggagcaccugcauuaagaccauuaguaaucaaacaagaaccaagggaagaagaugaagcaaaacaauuagcauuagcuggauuauuuccauaucaaccaccaccaccaccaccaccaccacauccacaugcaucaccagcucauuuagcagcaccacaccuacaauuucaaauagcacauuguggacaaacuacuaugcauuuacaaccaggucauccaacaccaccaccaacaccaguaccaucaccacauccugcuccagcaaugggagcagcaggauuaccaggaccaggaggaucacuuaaagguuuagcaggaccacacccagaucuucgaacaggaggaggaggcggagguggugcaggagcaggaaaagccaaaaaaucaguugacaaaaauagcaaugaauacagaguaagacgagaaagaaauaauauagcaguaagaaaaagcagagauaaagcaaaacaaagaaauguagaaacacaacaaaaaguauuagaauuaacaucagacaaugaucguuuaagaaaacgaguagaacaacuuaguagagaauuagacacauuaagaggaauuuuuagacaauuaccagaaucaucauuaguaaaagcaaugggaaauugugcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 582 - RNA, 1297 nt, Artificial Sequence
  mRNA product Design1 comprising derived and/or modified sequence from Mus musculus__NP_031704.2 __MmCebpa (opt6)
gggagaaagcuuaccauggaaucagcagauuuuuaugaaguagaaccacgaccaccuaugaguucucacuuacaaaguccaccacacgcaccaucaaaugcugcauuuggcuucccuagaggcgcaggaccagcaccaccuccugcaccaccagccgcaccagaaccauuaggaggaauuugugaacaugaaacaucuauagauauaucagcauauauagacccagcagcauucaaugaugaauuuuuagcagaucuauuccaacacaguagacaacaagaaaaagcuaaagcagcagcaggaccagcaggaggaggcggagacuuugauuauccuggagcaccugcaggaccuggaggugcaguaaugucagcaggugcacaugguccaccaccuggauauggaugugcugcagcaggauaccuagauggaagauuagaaccacuauaugaaagaguuggugcaccugccuuaagaccauuagucauuaaacaagaaccaagagaagaagaugaagcaaaacaauuagcacuagcaggauuauucccauaucaaccaccacccccccccccaccaccacauccacaugcaucaccagcacauuuagcagcuccacauuuacaauuucaaauagcacauuguggccaaacaacuaugcauuugcaaccaggacauccaacaccaccaccaacaccagucccaucuccucacgcugcaccagcacuuggugcagcaggauuaccaggaccaggaagugcacuuaaaggauuggcaggagcccaucccgauuuaagaacaggaggagguggaggaggaaguggagcaggugcaggaaaagcaaaaaaaaguguagauaaaaauagcaacgaauauagaguacgaagagaaagaaauaauauagcaguaagaaaaucaagagauaaagcaaaacaaaggaauguugaaacacaacaaaaaguauuagaauuaacauccgauaaugacagauuacgaaaaagaguagaacaacucucaagagaauuagauacacuaagagguauauuuagacaauuaccagaaucaucauuaguuaaagcaaugggaaauugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 583 - RNA, 1255 nt, Artificial Sequence
  mRNA product Design1 comprising derived and/or modified sequence from Mus musculus__NP_031704.2 __MmCebpa(15-359) (opt6)
gggagaaagcuuaccaugucuagccauuuacaaucaccaccacaugcaccaucaaaugcugcauuuggcuuucccagaggagcagguccugcaccacccccagcuccuccagccgcuccugaaccauuaggaggaauaugugaacaugaaacaucaauagacauuucagcauauauagacccagcagcauuuaaugaugaauuucuagcagauuuauuucaacacagcagacaacaagaaaaagccaaagcagcagcaggaccagcaggaggugguggagauuuugauuacccaggcgcaccagcaggucccggaggugcaguuaugucagccggagcucauggaccaccaccuggcuacggcugugcagcagcaggauauuuagacgguagacuagaaccauuauacgaaagaguaggagccccagcacuaagaccauuaguaauaaaacaagaaccaagagaagaagaugaagcaaaacaauuagcauuagcuggauuauuuccauaucaaccaccaccuccaccuccaccaccacauccccaugcuucaccagcacaucuugcagcaccacauuuacaauuucaaauagcucauuguggacaaacaacaaugcaccuacaaccaggacacccaacaccaccaccuacuccaguaccauccccacaugcugcaccagcacuaggagcagcuggccuuccaggcccaggaucugcacuuaaaggauuagcaggagcucauccggauuuaagaacaggaggaggaggaggaggaucaggagcaggagcagguaaagcuaaaaaaucaguagauaaaaauucaaacgaauacagaguaagacgagaacgaaauaacauagccguaagaaaaucaagagauaaagcaaaacaaagaaacguagaaacacaacaaaaaguauuagaacuaacaagugauaaugaucgacuaagaaaaagaguagaacaacuaucaagagaauuagauacacuucguggaauauuuagacaauuaccagaaucaucauuaguuaaagcaaugggaaauugugcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 584 - RNA, 1294 nt, Artificial Sequence
  mRNA product Design1 comprising derived and/or modified sequence from Homo sapiens__NP_004355.2__HsCEBPA (opt6)
gggagaaagcuuaccauggaaucagcagauuuuuacgaagcagaaccaagacccccaaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 585 - RNA, 1252 nt, Artificial Sequence
  mRNA product Design1 comprising derived and/or modified sequence from Homo sapiens__NP_004355.2__HsCEBPA(15-358) (opt6)
gggagaaagcuuaccaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 586 - RNA, 1642 nt, Artificial Sequence
  mRNA product Design1 comprising derived and/or modified sequence from Homo sapiens__NP_000448.3__HsHNF4A (opt6)
gggagaaagcuuaccaugcgauuaucaaaaacacucguagauauggauauggcggacuacucagcagcauuagaccccgcauauaccacauuagaauuugaaaacguccaaguauuaacaaugggaaaugacacaucucccucagaaggaacaaaccucaacgcaccaaacucucuaggaguaucagcucuaugcgccauaugcggagaccgagccacaggaaaacacuacggagcaucaucaugugacgguugcaaaggauucuucagaagaucuguaagaaaaaaucacauguacucaugcagauucucuagacaaugcguugucgacaaagacaaaagaaaucaaugcagauacugcagacugaaaaaaugcuucagagcaggaaugaaaaaagaagcaguacaaaacgaaagagauagaauuuccacacguagaucuucauaugaagacuccucauuaccaucaauaaaugcacuauuacaagcagaaguacuaucacgacaaauaaccucccccguaucaggaauuaacggagauauaagagcaaaaaaaauagcaucaauagccgauguaugcgagagcaugaaagaacaacuauuaguacuuguagaaugggcaaaauacaucccagcuuuuugcgaauuaccguuagaugaccaaguagcauuauuaagagcacacgcaggagaacaucuauuacucggugcaacaaaaagauccaugguauucaaagacguccuacuucuaggaaacgacuacauaguaccacgccacugccccgaauuagcagaaauguccagaguuaguauaagaauacuagacgaauuaguacuaccauuccaagaacuacaaauagaugacaacgaauaugcauauuuaaaagcaaucaucuucuucgauccagacgcaaaaggacuauccgauccugguaaaauaaaaagguuaagaucacaaguacaaguaucacuugaggauuacaucaacgauagacaauacgacucacgagguagguuuggagaacuauuacuuuuauuaccaaccuuacaaucaaucacauggcaaaugauagaacaaauacaauucaucaaacuauucggaauggccaaaauagacaaccuacuacaagaaauguuauuaggaggaucaccaucugacgcaccacacgcacaccauccacuacacccacaucuaaugcaagaacacauggguacaaacguaauagucgcaaauacaaugccaacacaccuaucuaacggacaaaugugcgaauggccacgcccacgaggacaagcagcaacaccugaaaccccacaaccaucaccacccggagguucaggaucagaaccauacaaacuccuaccuggagcaguagcaacaauaguaaagccauuaucagcaauaccacaaccaacaauaacaaaacaagaaguaauauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 587 - RNA, 847 nt, Artificial Sequence
  mRNA product Design1 comprising derived and/or modified sequence from Homo sapiens__NP_061986.1__HsFGF21 (opt6)
gggagaaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 588 - RNA, 1573 nt, Artificial Sequence
  mRNA product Design1 comprising derived and/or modified sequence from Homo sapiens__NP_078852.3__HsOGFRL1 (opt6)
gggagaaagcuuaccaugggaaauuuauuagguggaguauccuucagagaaccaacaacagucgaagacugugacagcacauggcaaacggacucagaaccagaaccagaagaaccaggaccaggaggaggaucagaaggaccaggucaagaaucagaacaaccagcacaaccaccagaacaagcaggaggaagaccaggugcauccccagccccagacgaagacgcagaagcagccggagcagaacaaggaggugacaguacagaagcuaccgcaaaacccaaacgaucauucuacgcagcaagagaccuuuacaaauacagacaccaguauccaaacuucaaagacauuagauaccaaaaugauuuaagcaaccuacgauuuuauaaaaauaaaauaccauucaaacccgacggagucuacauagaagaaguacuaucaaaauggaaaggcgauuacgaaaaauuagaacauaaccacacauacauacaaugguuauucccacucagagaacaaggauuaaauuuuuaugcaaaagaacuuacaacauacgaaauagaagaauuuaaaaaaacaaaagaagcaauacgcagauuccuacuggcauacaaaaugaugcuagaauuuuucggcauaaaauuaacagacaaaaccggcaacguagcaagagcaguaaacuggcaagaacgauuccaacaucuaaacgaaagccaacacaacuaccugagaauaacacgcauacuaaaaucacuaggagaacuaggcuaugaauccuuuaaaagcccauuaguaaaauucauacuacaugaagccuuaguagaaaacacaauaccaaacauaaaacaaucagcauuagaauacuucguauauacaauaagagacagaagagaaagaagaaagcuauuacgauuugcacaaaaacauuacacacccucagaaaacuucaucuggggcccaccaagaaaagaacaaucagaaggaucaaaagcacaaaaaaugagcucaccacuagcaaguucacauaacucacaaacauccaugcauaaaaaagcaaaagauucaaaaaauuccucaucagcaguacaccuaaacaguaaaacugccgaagacaaaaaaguagcaccaaaagaaccaguagaagaaacagacagacccucaccugaaccuagcaacgaagcagcaaaaccaagaaauacagaaaaagauucaaacgcagaaaauaugaacucacaaccagaaaaaacugucaccacaccaacagaaaaaaaagaaucaguaucaccagaaaauaacgaagaaggaggcaacgauaaccaagacaacgaaaacccagguaacacaaacugucacgacgucguauuaguucaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 589 - RNA, 775 nt, Artificial Sequence
  mRNA product Design1 comprising derived and/or modified sequence from Homo sapiens__NP_008842.1__HsRLN1 (opt6)
gggagaaagcuuaccaugccaagacuauucuuauuccaccuauuagaauuuugccuacuacuaaaccaauuuuccagagcaguagcagcaaaauggaaagacgacguaauaaaauuaugcggaagagaacucguaagagcacaaauagcaauaugcggaaugucaacauggucaaaaagaucacuaucacaagaagacgcaccacaaacaccaagaccaguagcagaaauagucccaucauucauaaacaaagacacagaaacaauaauaauaaugcuagaauuuauagcaaacuuaccacccgaacuaaaagcagcacuaucagaaagacaaccaucacuaccagaacuacaacaauacgucccagcacuaaaagacucaaaccuauccuucgaagaauuuaaaaaacucauaagaaacagacaaucagaagcagcagacucaaacccauccgaacuaaaauaccuaggacuagacacacacucacaaaaaaaaagaagaccauacguagcccuauucgaaaaaugcugccuaauaggauguacaaaacgcucacuagcaaaauacugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 590 - RNA, 775 nt, Artificial Sequence
  mRNA product Design1 comprising derived and/or modified sequence from Homo sapiens__NP_604390.1__HsRLN2 (opt6)
gggagaaagcuuaccaugccaagacuauucuucuuccaccuacuaggaguaugccuacuccuaaaccaauucuccagagcaguagcagacucauggauggaagaaguaauaaaacuaugcggaagagaacuuguaagagcacaaauagcaauaugcggaauguccacauggucaaaaagaucacuaucacaagaagacgcaccacaaacaccaagaccaguagcagaaauaguaccaucauucauaaacaaagauacagaaacaauaaacaugaugucagaauuugucgcaaaccuaccacaagaauuaaaacuaacauuaucagaaaugcaaccagcccuaccacaacuacaacaacacguacccguacuaaaagacucaucauuacuauucgaagaauuuaaaaaacuaauaagaaacagacaaucagaagcagcagacagcucaccaucagaauuaaaauaccucggacuagacacacacucaagaaaaaaaagacaauuauacucagcacuagcaaacaaaugcugccacguaggaugcacaaaaagaucacuagccagauucugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 591 - RNA, 646 nt, Artificial Sequence
  mRNA product Design1 comprising derived and/or modified sequence from Homo sapiens__NP_543140.1__HsRLN3  (opt6)
gggagaaagcuuaccauggcaagauauauguuauuauuauuauuagcaguauggguacuaacaggagaauuauggccaggagcagaagcaagagcagcaccauauggaguaagauuguguggaagagaauuuauaagagcaguaauauuuacauguggaggaagcagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaggcauuuuauagaggaagaccaaguuggcaaggaacaccaggaguauuaagaggaagcagagauguauuagcaggauuaaguaguaguuguuguaaauggggauguaguaaaagugaaauaaguaguuuauguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 592 - RNA, 1627 nt, Artificial Sequence
  mRNA product Design1 comprising derived and/or modified sequence from Homo sapiens__NP_002412.1__HsMMP1 (opt6)
gggagaaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 593 - RNA, 1387 nt, Artificial Sequence
  mRNA product Design1 comprising derived and/or modified sequence from Homo sapiens__NP_002412.1__HsMMP1(1-19,100-469) (opt6)
gggagaaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 594 - RNA, 3574 nt, Artificial Sequence
  mRNA product Design1 comprising derived and/or modified sequence from Clostridium histolyticum__BAA77453.1__ColG (opt6)
gggagaaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 595 - RNA, 3298 nt, Artificial Sequence
  mRNA product Design1 comprising derived and/or modified sequence from Clostridium histolyticum__BAA77453.1__HsALB(1-18)_ColG(111-1118) (opt6)
gggagaaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 596 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt6)
gggagaaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 597 - RNA, 3322 nt, Artificial Sequence
  mRNA product Design1 comprising derived and/or modified sequence from Clostridium histolyticum__BAA34542.1__ColH (opt6)
gggagaaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 598 - RNA, 3283 nt, Artificial Sequence
  mRNA product Design1 comprising derived and/or modified sequence from Clostridium histolyticum__BAA34542.1__ColH (opt6)
gggagaaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 599 - RNA, 3217 nt, Artificial Sequence
  mRNA product Design1 comprising derived and/or modified sequence from Clostridium histolyticum__BAA34542.1__HsALB(1-18)_ColH(41-1021) (opt6)
gggagaaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 600 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt6)
gggagaaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 601 - RNA, 1063 nt, Artificial Sequence
  mRNA product Design1 comprising derived and/or modified sequence from Homo sapiens__NP_003801.1__HsTNFSF10 (opt7)
gggagaaagcuuaccauggccaugauggaggugcagggcgggcccagccugggucaaaccugcguccucaucgugauuuucacuguacuguugcagucccuguguguggcagucaccuacguguauuuuacgaacgaacucaagcagaugcaggacaaauacaguaagagcggcaucgccugcuuccugaaagaggaugacuccuauugggauccaaaugacgaagagaguaugaacagcccguguuggcaagugaaguggcaguugaggcagcugguccggaaaaugauucuccgcacuuccgaagagaccaucagcaccgugcaggagaagcaacagaauauuaguccccugguaagggaacgggggccacagcgcguggcggcccacaucacuggcaccaggggucgguccaacacgcugagcucccccaauagcaagaacgagaaagcacucgggcgcaagaucaauaguugggaauccagcagguccggccauaguuuucugagcaacuugcaucugcggaauggcgagcucgucauucacgagaaaggguucuacuauaucuacucccagacuuauuuucgcuuccaagaagagauuaaggaaaacaccaaaaaugauaagcagauggugcaguacaucuacaaauauacuagcuacccagaccccauucugcugaugaagagugccaggaacuccugcuggagcaaggaugcagaguaugguuuguacaguaucuaucaaggcgggauuuuugaacucaaagagaaugaccggaucuucguguccgucaccaacgagcaccugaucgauauggaccaugaagccagcuuuuucggcgcguuucugguggguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 602 - RNA, 784 nt, Artificial Sequence
  mRNA product Design1 comprising derived and/or modified sequence from Homo sapiens__NP_003801.1__HsTNFSF10(95-281) (opt7)
gggagaaagcuuaccaugaccagcgaggaaacuaucuccaccgugcaggagaagcaacagaacauuaguccccuggucagggaacggggcccacagcgcguggccgcacacaucacggggacuaggggucggagcaauacccucuccaguccgaacagcaaaaaugagaaggcccugggccgcaaaauuaacuccugggaaagcuccaggagugggcauagcuucuuguccaaucugcaccuccggaacggcgagcugguaauccaugagaaggguuuuuacuauauuuacagccagaccuauuuccgcuuucaagaagagaucaaagaaaauacuaagaacgacaagcagauggugcaguacaucuauaaauacaccaguuaucccgauccaauuuugcugaugaaguccgcgaggaauagcugcugguccaaagacgccgaguacgggcucuacaguaucuaucagggcggcauuuucgagcugaaggaaaacgaucggaucuuugucagcgugacgaaugagcaccugauugacauggaucaugaagcauccuucuuuggggccuuccucguggguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 603 - RNA, 835 nt, Artificial Sequence
  mRNA product Design1 comprising derived and/or modified sequence from Homo sapiens__NP_003801.1__HsALB(1-18)_HsTNFSF10(95-281) (opt7)
gggagaaagcuuaccaugaagugggugaccuucaucagccugcucuuucuguucuccagugccuacagcacuuccgaggaaaccauuaguacgguccaggagaaacaacagaacaucagccccuuggugagggaacggggcccacagcgcguagcagcccacauuacugggaccaggggucgguccaauacccugagcuccccgaacaguaagaaugagaaagcgcucggccgcaagaucaacagcugggaauccagcaggagugggcauuccuuucugagcaauuugcaucugcggaacggcgagcucgugauucacgagaaagguuucuauuacaucuauucccagacuuacuuucgcuuccaagaagagaucaaggaaaauaccaagaacgacaaacagaugguccaguauauuuacaaguauacgaguuaccccgauccaauccugcugaugaaaagcgccaggaacuccugcuggagcaaggacgcagaguacgggcucuauaguauuuaccagggcggcaucuuugagcugaaagaaaaugaucggauuuucguguccgugacuaaugagcacuugaucgacauggaucaugaagccagcuuuuucggggcauuucuggucgguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 604 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt7)
gggagaaagcuuaccaugaagugggugaccuucaucagccugcucuuucuguucuccagugccuacagcaggaugaaacagauugaggacaagaucgaagagauuuuguccaaaaucuaucacauugaaaacgagaucgcacggaucaagaaacugauuggcgaaaccagugaggagacuaucagcacgguccaagaaaagcagcagaauauuaguccccucgugcgcgagagggggccacagcggguagccgcgcauaucacugguacccgcggcaggagcaacacccuguccaguccgaauagcaagaacgaaaaagccuuggggcggaagauuaauuccugggagagcagucgcuccggccacagcuuucuguccaaccuccaucugaggaauggugagcuggugauccacgaaaaaggguucuacuauauuuacagucaaacuuauuuucgguuccaggaggaaaucaaggagaacaccaaaaaugauaagcagaugguccaguacaucuauaaauacacgagcuaccccgacccaauucuccugaugaaguccgcacgcaacagcugcuggaguaaggaugccgaauauggcuuguacuccaucuaucaaggcgggauuuuugagcugaaagagaaugacaggaucuucgugagcgugacuaacgaacaucucauugauauggaccacgaggcauccuuuuucggugccuuucuggucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 605 - RNA, 1294 nt, Artificial Sequence
  mRNA product Design1 comprising derived and/or modified sequence from Rattus norvegicus__NP_036656.1__RnCebpa (opt7)
gggagaaagcuuaccauggagagcgccgacuucuacgaagcagagcccaggccaccgauguccagucaucugcagagcccaccccacgcccccuccaacgcggccuuuggcuucccccgcggggcaggucccgccccaccgcccgcaccacccgccgcgccagaaccccucggcgggaucugcgagcacgaaaccaguauugauaucagcgccuauauugacccggcagccuuuaaugaugaguuccuggccgacuuguuucaacauucccggcagcaggagaaggcaaaagccgcggccggccccgccggugggggcggcgauuucgacuacccaggggcccccgcagguccaggcggggccgugaugagcgccggcgcgcacggucccccaccgggguauggcugugcagccgccggcuaccuggaugggaggcucgaaccccuguaugagcgggucggugcaccagccuugcgcccccuggugaucaagcaggaaccaagggaggaggacgaagcgaaacaacucgcccuggcaggccuguuucccuaccagccgccaccacccccacccccaccgcauccccacgccuccccagcacaccucgccgcaccccaucugcaguuccagauugcacacugcgggcaaacuaccaugcauuugcagccaggccaccccacgccgccacccacuccaguacccaguccgcaccccgccccagcgaugggugccgcaggccugcccgggccaggcgggagccucaagggucuggccggcccccauccagaucugcggaccgggggcgguggcgggggcggggccggcgcagguaaagcgaagaaguccguggacaaaaacagcaaugaguaucgcgucaggcgggaacgcaacaauaucgccgugaggaagagucgggauaaagcaaagcagcgcaacguggagacccagcaaaaagucuuggaacucacuuccgacaaugauaggcugcggaagcgcguggagcagcugagcagggagcucgacacccugcgggggaucuuucgccaguugccggaauccagucugguaaaagccaugggcaacugugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 606 - RNA, 1252 nt, Artificial Sequence
  mRNA product Design1 comprising derived and/or modified sequence from Rattus norvegicus__NP_036656.1__RnCebpa(15-344) (opt7)
gggagaaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacccagcccccgcaaugggugccgcgggccugccggggcccggcgggagucucaagggucuggccggcccacaucccgaccugaggaccgggggcgguggcgggggcggggcaggcgccgguaaagccaaaaagagcguggauaagaacuccaaugaguaccggguccgcagggagcggaacaauaucgcagugcgcaagagcagggacaaagcgaagcagcggaacguggaaacccagcaaaaagucuuggagcucacuuccgauaaugaccgccugaggaagcggguggaacagcugucccgcgagcucgauacccugagggggaucuuccggcaguugccagaaagcucccugguaaaagccaugggcaacugugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 607 - RNA, 1297 nt, Artificial Sequence
  mRNA product Design1 comprising derived and/or modified sequence from Mus musculus__NP_031704.2 __MmCebpa (opt7)
gggagaaagcuuaccauggagagcgccgacuucuacgaaguggagcccaggccaccgauguccagucaucugcagagcccaccccacgcacccuccaacgccgcguuuggcuucccccgcggggccggucccgcaccaccgcccgccccacccgcagccccagaaccccucggcgggaucugcgagcacgaaaccaguauugauaucagcgcguauauugacccggccgcauuuaaugaugaguuccuggccgacuuguuucaacauucccggcagcaggagaaggccaaagcagccgcgggccccgccggugggggcggcgauuucgacuacccaggggcacccgccgguccaggcggggcagucaugagcgccggcgcccacggucccccaccgggguauggcugugcggcagccggcuaccuggaugggaggcucgaaccccuguaugagcgggugggugccccagcauugcgcccccugguaaucaagcaggaaccaagggaggaggacgaagccaaacaacucgcgcuggccggccuguuucccuaccagccgccaccacccccacccccaccgcauccccacgcauccccagcccaccucgcagcaccccaucugcaguuccagauugcccacugcgggcaaacuaccaugcauuugcagccaggccaccccacgccgccacccacuccagugcccaguccgcacgccgcccccgcgcugggugccgcaggccucccagggcccggcagcgcccugaaggggcuggccggugcacauccagauuugcggaccggcgggggcgguggcggguccggcgcgggggccggcaaagcaaagaaaagcgucgacaagaacaguaaugaguaucgcgugaggcgggaacgcaacaauaucgccgugaggaagucccgggauaaagccaagcagcgcaacgucgagacccagcaaaaagugcucgaacugacuagcgacaaugauaggcugcggaagcgcguagagcagcucuccagggagcuggacaccuugcgggguaucuuucgccagcugcccgaaaguagccucgugaaagcaauggggaacugugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 608 - RNA, 1255 nt, Artificial Sequence
  mRNA product Design1 comprising derived and/or modified sequence from Mus musculus__NP_031704.2 __MmCebpa(15-359) (opt7)
gggagaaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacgccgcaccagcccugggugcggccggccuccccgggccgggcuccgcacugaaggggcuggccggugcccaucccgacuugaggaccggcgggggcgguggcgggagcggcgcaggggcgggcaaagccaagaaguccguggauaaaaacagcaaugaguaccggguccgcagggagcggaacaauaucgcagugcgcaagaguagggacaaagccaagcagcggaacguggaaacccagcaaaaaguccucgagcugacuuccgauaaugaccgccugaggaagcggguggaacagcucagccgcgagcuggauaccuugagggguaucuuccggcagcugccagaauccagucucguaaaagccauggggaacugugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 609 - RNA, 1294 nt, Artificial Sequence
  mRNA product Design1 comprising derived and/or modified sequence from Homo sapiens__NP_004355.2__HsCEBPA (opt7)
gggagaaagcuuaccauggagagcgccgacuucuacgaagcagagcccaggccaccgauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 610 - RNA, 1252 nt, Artificial Sequence
  mRNA product Design1 comprising derived and/or modified sequence from Homo sapiens__NP_004355.2__HsCEBPA(15-358) (opt7)
gggagaaagcuuaccauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 611 - RNA, 1642 nt, Artificial Sequence
  mRNA product Design1 comprising derived and/or modified sequence from Homo sapiens__NP_000448.3__HsHNF4A (opt7)
gggagaaagcuuaccaugaggcugagcaagacccucguggacauggauauggccgacuacuccgcagcccuggaucccgcguauacuaccuuggaguucgaaaacguccaggugcugacgaugggcaaugacacuagcccaagcgaggggaccaaccucaaugccccgaacucccuggguguaagugcauugugcgccaucuguggcgaucgggcaaccgggaaacacuacggcgccagcuccugcgacgguuguaagggguuuuuccgcaggagcgugcggaaaaaucauauguauuccugccgcuuuaguaggcaaugugucguggauaaggacaaacggaaccagugccgcuacuguaggcugaagaagugcuuccgggcgggcaugaaaaaggaagccgugcagaaugagcgcgauaggauuagcacucggcgcuccagcuaugaagacaguucccuccccagcaucaacgcacugcugcaggccgagguccucuccaggcaaauuaccaguccagugagcggcaucaauggggauauucgggccaaaaagaucgcauccaucgccgacguaugugagagcaugaaagaacagcuguuggugcuggucgagugggcgaaguacauucccgccuuuugcgaacucccacuggaugaccagguggcacuguugcgcgcccacgccggugagcaucuccugcugggcgcaacgaaaaggaguaugguguucaaggacguccuccuguuggggaacgauuauaucgugccccggcacugcccagagcuggccgaaaugucccgcguaagcauuaggauccucgacgagcuggugcugccguuucaggaauugcaaauugaugacaaugaguacgcguaccucaaggcaaucauuuucuuugaucccgacgccaaaggccugagugauccagguaagaucaaacggcugaggucccagguccaggugagccucgaagacuauaucaacgaucgccaguacgacagccgggggagguucggcgagcuguugcugcuccugcccacucugcaauccauuaccuggcagaugaucgagcagauucaauuuaucaaguuguucggcauggccaaaauugauaaucuccugcaggaaaugcugcucggggguaguccaagcgacgcaccccaugcccaccacccgcugcauccccacuugaugcaggagcauaugggcacuaacgugaucgucgcgaauaccaugccaacccaccuguccaacgggcagaugugugaauggccccgcccacggggccaagccgcaacgcccgagacuccacagccgagucccccagguggcaguggguccgaacccuauaagcuccugccaggcgccguggcaaccaucguaaagccccugagcgccauuccgcagccaacuaucaccaaacaggaggugauuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 612 - RNA, 847 nt, Artificial Sequence
  mRNA product Design1 comprising derived and/or modified sequence from Homo sapiens__NP_061986.1__HsFGF21 (opt7)
gggagaaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 613 - RNA, 1573 nt, Artificial Sequence
  mRNA product Design1 comprising derived and/or modified sequence from Homo sapiens__NP_078852.3__HsOGFRL1 (opt7)
gggagaaagcuuaccaugggcaaccugcucgggggugugagcuucagggagcccaccacugucgaagacugcgauuccaccuggcagacggacagugagccagaaccggaggaacccggcccagggggcgguagcgaggggcccggccaagaguccgaacagccagcccagcccccagagcaggcaggcgggcggccgggugccagucccgcgccagaugaagacgccgaggcagccggcgcagagcaagggggcgauagcacugaagccaccgcgaagcccaaacgcuccuuuuacgccgcaagggaccuguauaaguaccggcaccaguauccaaauuucaaagauauccgcuaccagaacgacuugagcaaucugagguuuuauaagaacaaaauucccuucaagccggaugguguguacaucgaggaaguacucuccaaguggaaaggggacuaugagaagcuggaacauaaucacaccuacauucagugguuguuuccccugcgggagcaaggccucaacuucuacgccaaagagcugacuaccuaugaaaucgaggaauuuaagaaaacgaaggaggccauucgcagguuccugcucgcauacaaaaugaugcuggaauuuuucggcaucaaguugacugauaagaccgggaauguggcccgggcggucaacuggcaggagcgcuuucagcaucugaaugagagucagcacaacuaucucaggaucacucggauucugaaaagccugggugaauugggcuacgaguccuucaagagcccacucgugaaauucauccugcaugaagcccugguggagaauaccauucccaacaucaagcaaagugcacucgaauauuuugucuacaccauucgcgacaggcgggagcgcaggaaacuguugcgguucgcccagaagcacuauacgccauccgagaauuuuaucugggggcccccacgcaaggaacagagcgagggcuccaaagcacaaaagaugaguagcccgcuggccuccagccacaacagucagacuuccaugcauaaaaaggccaaagauagcaagaauaguuccagcgcggugcaccucaacagcaagaccgcagaagacaaaaagguagcccccaaagagccaguggaggaaacugacaggcccuccccagagcccaguaacgaagccgcaaagccgcggaauaccgagaaagauagcaacgccgaaaauaugaacucccagccagagaagaccgucacuacgcccaccgagaagaaagaaagcgugagucccgagaauaacgaagaggguggcaaugacaaccaggauaaugaaaacccagggaauacuaacugucaugacgugguccuggugcaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 614 - RNA, 775 nt, Artificial Sequence
  mRNA product Design1 comprising derived and/or modified sequence from Homo sapiens__NP_008842.1__HsRLN1 (opt7)
gggagaaagcuuaccaugcccaggcuguuccucuuucaccuguuggaguucugccugcuccugaaccaguuuagccgggccguggcagccaaguggaaagacgaugucaucaaguuguguggccgcgaacuggugagggcgcaaauugccaucugcgggauguccaccuggaguaaacggagccucucccaggaggacgcaccacagacuccgcgccccguagccgaaauugugccaaguuucaucaauaaggauaccgagacgauuaucaucaugcuggaauuuauugcaaaccugcccccagagcucaaagccgcgcugagcgagaggcagcccuccuugccagaacugcaacaguacgucccggcccucaaggacagcaaucuguccuucgaggaauuuaagaaacugauccggaaccgccagagugaggcagccgauagcaaucccuccgaguugaaguaucucggucuggacacucauagccagaaaaagaggcggccauacguggcccuguucgaaaaauguugccucauuggcuguaccaagcgcagucuggcaaaauauugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 615 - RNA, 775 nt, Artificial Sequence
  mRNA product Design1 comprising derived and/or modified sequence from Homo sapiens__NP_604390.1__HsRLN2 (opt7)
gggagaaagcuuaccaugcccaggcuguucuuuuuccaccuccugggcgugugcuugcugcucaaccaguuuagccgggccgucgcagacuccuggauggaggaagugaucaagcugugugggcgcgaguugguaagggcccaaauugcgaucugcgguaugaguaccuggagcaaacggucccugagucaggaagaugccccacagacuccgcgccccguggcagagauuguccccagcuucaucaauaaggacaccgaaacgauuaacaugauguccgaguuuguggccaaucucccacaggagcugaaacugacucucagcgaaaugcaaccagcacugccccaguugcagcagcaugugccaguccugaaggauuccagucuccuguucgaggaauuuaaaaagcugaucaggaaccggcaaagcgaggccgcggacuccagcccgagugaguugaaguaccucggccuggauacccacucccgcaaaaagaggcagcuguauagcgcccucgcaaauaaauguugccaugugggguguaccaagcggucccuggcccgcuucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 616 - RNA, 646 nt, Artificial Sequence
  mRNA product Design1 comprising derived and/or modified sequence from Homo sapiens__NP_543140.1__HsRLN3  (opt7)
gggagaaagcuuaccauggccagguacaugcugcuccuguugcuggcaguguggguccucaccggcgagcuguggcccggggccgaagcgcgggccgcaccauauggugugcgcuugugcggcagggaguucauccgggccguaauuuuuacuugugggggcagccgcuggaggcgguccgacauccuggcacacgaagccaugggugauaccuucccggacgcggaugccgacgaggauagucucgcaggggaacuggacgaggccaugggcagcuccgaguggcuggcccucacgaagaguccccaggcauuuuaccgcggcaggccaagcuggcaagggacucccggugugcugcggggcucccgcgaugucuuggccgggcugagcuccaguugcuguaaauggggcugcagcaaguccgaaauuagcagucucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 617 - RNA, 1627 nt, Artificial Sequence
  mRNA product Design1 comprising derived and/or modified sequence from Homo sapiens__NP_002412.1__HsMMP1 (opt7)
gggagaaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 618 - RNA, 1387 nt, Artificial Sequence
  mRNA product Design1 comprising derived and/or modified sequence from Homo sapiens__NP_002412.1__HsMMP1(1-19,100-469) (opt7)
gggagaaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 619 - RNA, 3574 nt, Artificial Sequence
  mRNA product Design1 comprising derived and/or modified sequence from Clostridium histolyticum__BAA77453.1__ColG (opt7)
gggagaaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 620 - RNA, 3298 nt, Artificial Sequence
  mRNA product Design1 comprising derived and/or modified sequence from Clostridium histolyticum__BAA77453.1__HsALB(1-18)_ColG(111-1118) (opt7)
gggagaaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 621 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt7)
gggagaaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 622 - RNA, 3322 nt, Artificial Sequence
  mRNA product Design1 comprising derived and/or modified sequence from Clostridium histolyticum__BAA34542.1__ColH (opt7)
gggagaaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 623 - RNA, 3283 nt, Artificial Sequence
  mRNA product Design1 comprising derived and/or modified sequence from Clostridium histolyticum__BAA34542.1__ColH (opt7)
gggagaaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 624 - RNA, 3217 nt, Artificial Sequence
  mRNA product Design1 comprising derived and/or modified sequence from Clostridium histolyticum__BAA34542.1__HsALB(1-18)_ColH(41-1021) (opt7)
gggagaaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 625 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt7)
gggagaaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 626 - RNA, 1063 nt, Artificial Sequence
  mRNA product Design1 comprising derived and/or modified sequence from Homo sapiens__NP_003801.1__HsTNFSF10 (opt8)
gggagaaagcuuaccauggccaugauggaaguacaaggaggccccucacucggccaaaccugcguccucaucguaaucuucaccguccuccuccaaucccucugcgucgcgguaacauacgucuacuucacaaacgaacucaaacaaaugcaagacaaauacuccaaauccggaaucgccugcuuucuaaaagaagacgacuccuacugggaccccaacgacgaagaaagcaugaacucccccuguuggcaagucaaauggcaacuccgccagcucguccgaaaaaugauacuacgcaccuccgaagaaacuaucuccaccguccaagagaaacaacaaaacaucuccccacugguccgagaacgaggcccccaacgcguagccgcccacaucacuggcacacgaggacgcuccaacacccuaucaucccccaacuccaaaaacgaaaaagcccuaggccgcaaaaucaacucaugggagucaucccgauccggccacuccuuccucuccaaccuacaccuacgcaacggagaacucgucauacacgaaaaaggauucuacuacauauauucccaaaccuacuuccgcuuccaagaggaaauaaaagaaaacaccaaaaacgacaaacaaaugguccaauacauauacaaauacacauccuaccccgaccccauacuccucaugaaauccgcccgcaacucuugcugguccaaggacgcagaauacggacucuacucaaucuaccaaggcggaauauucgaacucaaagaaaacgaccgcaucuucguaucaguaaccaacgagcaccucaucgacauggaccacgaagccuccuucuucggcgccuuccucguaggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 627 - RNA, 784 nt, Artificial Sequence
  mRNA product Design1 comprising derived and/or modified sequence from Homo sapiens__NP_003801.1__HsTNFSF10(95-281) (opt8)
gggagaaagcuuaccaugacaucagaagaaaccaucuccacaguccaagaaaaacaacaaaacaucucaccccuaguacgcgaacgcggcccacaacgcguagccgcacacaucaccggcacccgcggaagauccaacacccucuccucccccaacuccaaaaacgaaaaagcccucggccgaaaaaucaacuccugggaauccagccgaucaggccacucauuccucucaaaccuacaccuccgaaacggcgaacucguaauccacgaaaaaggcuucuacuacaucuacucccaaaccuacuuccgcuuccaagaagaaauaaaagaaaacaccaaaaacgacaaacaaaugguccaauacaucuacaaauacaccuccuacccagaccccauccuacuaaugaaauccgcacgaaacuccugcuggucaaaagacgccgaauacggacucuacuccaucuaccaaggcggaaucuucgaacucaaagaaaacgaccgcaucuucgucagcguaaccaacgaacaccucaucgacauggaccacgaagccagcuucuucggagccuuccuagucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 628 - RNA, 835 nt, Artificial Sequence
  mRNA product Design1 comprising derived and/or modified sequence from Homo sapiens__NP_003801.1__HsALB(1-18)_HsTNFSF10(95-281) (opt8)
gggagaaagcuuaccaugaaaugggucaccuucaucucccuccuauuccuauucucaucagcauacuccaccagcgaagaaaccaucuccaccguccaagaaaaacaacaaaacaucuccccacucguccgcgaacgcggcccacaacgcgucgccgcccacaucaccggaacccgcggacgauccaacacacuauccucacccaacuccaaaaacgaaaaagcccucggacgcaaaauaaacucaugggaaucaucacgcucaggacacucauuccuguccaaccuccaccuacgaaacggcgaacucgucauccacgaaaaaggauucuacuacauauacucacaaaccuacuuccgcuuccaagaagaaaucaaagaaaacaccaaaaacgacaaacaaaugguccaauacaucuacaaauacaccuccuaccccgaccccauacuacucaugaaaucagcacgaaacuccugcugguccaaggacgccgaauacggccucuacuccauauaccaaggcggcaucuucgaacucaaagaaaacgaccguaucuucguaucaguaaccaacgaacaccucaucgacauggaccacgaagccuccuucuucggagccuuccuagucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 629 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt8)
gggagaaagcuuaccaugaaaugggugaccuucaucucacuccuauuccuguucucgagcgcauacucgcgcaugaaacaaaucgaggacaaaaucgaagaaauacucucgaaaaucuaccacaucgagaacgaaaucgcacgcaucaaaaagcucauaggcgaaaccucggaagaaaccauaagcacgguccaagaaaagcaacaaaacauaagcccacucguacgcgagcgcggaccccagcgcguggccgcacacauaaccgggaccaggggaagauccaacacccugagcucgcccaacagcaaaaacgaaaaagcgcucgggcgaaaaaucaacagcugggaauccuccaggagcgggcacucguuccuaagcaaccuccaccucagaaacggggaauuagucauacacgagaaaggguucuacuacauauacucacaaacauacuuccgcuuccaagaagaaauaaaagagaacacgaaaaaugacaaacaaaugguccaguauauauacaaauacacaagcuauccagauccaauacuccugaugaaaagcgcgcgcaacagcuguuggucaaaagaugccgaguacggccuauacuccauauaccagggcggaaucuucgaacucaaagaaaacgaucgcaucuucgugagcguaacaaacgaacaccucauagacauggaccacgaagcgagcuucuucggagccuuccucgugggauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 630 - RNA, 1294 nt, Artificial Sequence
  mRNA product Design1 comprising derived and/or modified sequence from Rattus norvegicus__NP_036656.1__RnCebpa (opt8)
gggagaaagcuuaccauggaaagcgcagacuucuacgaagcagaaccccgcccccccauguccucccaccuccaaucccccccccacgccccuuccaaugcagcauucggcuucccccgcggagcaggacccgcacccccaccagccccccccgccgcccccgaaccccucggcggaauaugcgaacacgaaacauccaucgacauauccgcuuacauugaccccgccgccuucaacgacgaauuccucgcagaccucuuucaacacagccgccaacaggaaaaagcaaaagccgcagccggccccgccggcggcggaggcgacuucgacuaccccggcgccccagccggaccaggaggcgccgucauguccgcaggcgcccacggccccccccccggcuacggcugcgcugccgccggcuaccucgacggccgccucgaaccccucuacgaacgagucggagccccagcacuccgaccacucguaaucaaacaagaaccccgcgaagaagacgaagcgaaacaacuugcacucgcaggccuauuccccuaccaaccccccccaccccccccacccccccacccccacgcauccccagcccaccucgccgcaccccaccuccaauuccaaauagcccauugcggccaaaccaccaugcaccuccaaccaggccaccccaccccaccccccacacccguaccaucgccucacccagcccccgcaaugggcgccgccggccuaccuggcccaggcggcagccucaaaggacuugcaggcccacaccccgaccucagaacaggcggcggcggcggcggaggcgccggcgccggcaaagcaaaaaaaucagucgacaaaaacuccaacgaauaccgaguccgacgcgaacgcaacaacaucgccguccgcaaaucccgcgacaaagccaaacaaagaaacguagaaacacaacaaaaaguucucgaacuuacaucagacaaugacagacuucgcaaacgcgucgagcaacuaucccgcgaacucgacacccuccgagguaucuuccgacaacuccccgaauccucccucgucaaagccaugggaaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 631 - RNA, 1252 nt, Artificial Sequence
  mRNA product Design1 comprising derived and/or modified sequence from Rattus norvegicus__NP_036656.1__RnCebpa(15-344) (opt8)
gggagaaagcuuaccauguccucccaccuccaaucccccccacacgcaccauccaacgccgccuucggcuuccccagaggcgccggccccgcccccccccccgccccccccgccgcccccgaaccccuaggcggcauaugcgaacacgaaaccuccaucgacaucucagccuacauagaccccgccgcauucaacgacgaauuccucgccgaccuuuuccaacacagccgucaacaagaaaaagccaaagccgccgccggaccagccggcggcggcggcgacuucgacuacccaggcgcccccgccggacccggcggcgccgucaugucagcaggagcccacggcccaccucccggcuacggaugcgccgcagcaggcuaccucgacggcagacuagaaccacuauacgaacgcgugggagcacccgcacuccgaccccucguaaucaaacaagaaccaagagaagaagacgaagccaaacaacucgcacucgccggccucuuccccuaccaaccacccccaccccccccacccccccacccccacgcauccccagcacaccuagccgccccccaccuucaauuccaaaucgcacacugcggccagacaacaaugcaccuccaacccggccaccccacacccccucccacccccgucccauccccccacccagcccccgcaaugggcgccgccggacuaccaggacccggcggaucccuaaaaggacucgccggcccccaccccgacuuacgcaccggcggcggcggcggcggaggcgccggggcaggcaaagccaaaaaauccgucgacaaaaacucaaacgaauacagaguacgccgagaacgaaauaacaucgccguccgaaagucacgcgacaaagcaaaacaacgaaacgucgaaacacaacaaaaaguacuagaacucaccuccgacaacgaccgacuacgaaaacgcgucgaacaacuuucacgcgaacucgacacccuccgcggaaucuuccgacaacuaccagaaucaucccuugucaaagccaugggaaauugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 632 - RNA, 1297 nt, Artificial Sequence
  mRNA product Design1 comprising derived and/or modified sequence from Mus musculus__NP_031704.2 __MmCebpa (opt8)
gggagaaagcuuaccauggaauccgccgacuuuuacgaaguagaaccccgcccacccauguccucccaucugcaaucaccuccccacgcccccuccaacgccgcauucggauucccccgcggcgcaggacccgccccacccccagccccacccgcagcccccgaaccccucggcggcauuugcgaacacgaaaccuccaucgacaucucagccuacauagaccccgccgccuucaacgacgaguuccucgccgaccuuuuccaacacucccgccaacaagaaaaagccaaagcagccgccggccccgccggaggcggcggagacuucgacuaccccggcgcacccgccggacccggaggcgccgucaugucagcaggcgcccauggacccccacccggcuacggaugugcagccgccggauacuuagacggccgccuagaaccccucuacgaacgcguaggcgcccccgcccuucgcccccucguuaucaaacaagaaccccgcgaagaagacgaagccaaacaacuagcccuagccggccucuuccccuaccaacccccacccccacccccgccaccccacccccaugcaucccccgcccaccuagccgcuccccaccuacaauuccaaaucgcacacugcggccaaacaaccaugcacuuacaacccggccaccccacacccccacccacccccgucccgucaccccacgccgccccagcccuaggagccgccggccuccccggacccggcuccgcccuaaaaggacucgccggcgcccacccagaccuccgaacaggcggcggcgguggcggcuccggcgccggggcaggaaaagccaagaaauccguagacaaaaacuccaacgaauaccgcguccgacgcgaaagaaacaacaucgccguccgaaaaucccgcgacaaagcaaaacaaagaaacgucgaaacacaacaaaaaguccuagaacuaaccuccgacaacgaccgccuucguaaacgcguagaacaacuaucccgcgaacucgacacccuacgcggcaucuuccgccaacuccccgaaucaucccucguuaaagcaaugggcaacugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 633 - RNA, 1255 nt, Artificial Sequence
  mRNA product Design1 comprising derived and/or modified sequence from Mus musculus__NP_031704.2 __MmCebpa(15-359) (opt8)
gggagaaagcuuaccaugucaagccaccuccaaucacccccccacgcccccucuaacgccgcauucgguuucccccgaggcgccgguccagccccacccccugcgcccccagccgccccagaaccccuuggaggaaucugcgaacacgaaaccuccauagacauaucagccuacaucgaccccgccgccuucaacgaugaauuccuagccgaccucuuccaacacucacgccaacaagaaaaagcaaaagccgccgccggcccagccggcggcggaggagacuucgacuacccaggcgcacccgcaggaccgggaggagccguaauguccgcaggcgcccacggcccaccccccggauacggaugcgcagccgccggcuaccucgacggacgacuagaaccacucuacgaaagagucggcgcccccgcccuacgcccccucguaauaaaacaagaaccccgagaagaagacgaagccaaacaacucgcccucgccggacucuuccccuaccaaccgccccccccccccccccccccacacccacacgcaucaccagcccaccuagcagccccccaccuacaauuccaaauagcccacugcggacaaaccaccaugcaccuacaaccaggccaccccaccccaccucccaccccagucccauccccacacgccgccccagcccucggcgccgccggacucccaggacccggcucagcccucaagggacuagccggagcacaccccgaccuccgaacaggcggaggaggcggcggcuccggagcuggugccggaaaagcaaaaaaauccgucgacaaaaacuccaacgaauacagaguccgccgagaacgaaacaacauagccguccgaaaaucccgagacaaagcaaaacaacgaaacgucgaaacccaacaaaaaguccuagaacuaaccucugacaacgaccgacuacgcaaacgagucgaacaacucagcagagaacucgacacccucagaggaauauuccgacaacuaccagaauccucccuagucaaagcuaugggaaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 634 - RNA, 1294 nt, Artificial Sequence
  mRNA product Design1 comprising derived and/or modified sequence from Homo sapiens__NP_004355.2__HsCEBPA (opt8)
gggagaaagcuuaccauggaauccgccgacuucuacgaagccgaaccacgaccccccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 635 - RNA, 1252 nt, Artificial Sequence
  mRNA product Design1 comprising derived and/or modified sequence from Homo sapiens__NP_004355.2__HsCEBPA(15-358) (opt8)
gggagaaagcuuaccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 636 - RNA, 1642 nt, Artificial Sequence
  mRNA product Design1 comprising derived and/or modified sequence from Homo sapiens__NP_000448.3__HsHNF4A (opt8)
gggagaaagcuuaccaugcgccuauccaaaacacucguagacauggauauggcagacuacuccgccgcccucgaccccgccuacacaacucuagaguucgaaaacguccaaguccucaccaugggcaacgauaccuccccauccgaaggaaccaaccucaacgccccaaacucccucggcgucucagcccuaugcgccaucugcggagaccgcgccaccgggaaacacuacggcgccucguccugugacgggugcaaagguuucuuccgccgcuccguccgcaaaaaucacauguacuccugccgauucucccgacaaugcgucguagacaaagauaaaagaaaccagugccgcuacugccgccugaagaaaugcuuccgcgcaggaaugaagaaagaagccguccaaaacgaacgcgaccgcaucucaacccgacgcuccucauaugaagacuccagccuccccucaaucaacgcacuacuacaagccgaaguccucagccgccaaauaacaucaccugucucuggcaucaacggagacaucagagcaaagaaaauugcaucaaucgcagacgucugcgaaucuaugaaagaacaacuccucguccugguugaaugggccaaauacaucccagccuucugcgaacucccccucgacgaccaagucgcacuacuccgcgcacacgccggcgaacaccuccuacucggcgccacaaaacgcuccauggucuucaaagacguccuccuccuaggcaacgacuacaucguccccagacacugccccgaacucgccgaaaugagccgagucucaauccggauacuagacgaacucguacucccauuccaagagcuucaaauagacgacaaugaauacgccuaccuuaaagcaauaauauucuucgauccagacgcuaaaggacucucugaccccggcaaaaucaaacgcuuacgaucccaaguccaagucucacuagaagacuacaucaacgaccgacaauacgacucccgcggcagauucggggaacuccuccuccuccuacccacacuccaaagcaucaccuggcaaaugaucgaacaaauccaauucauaaaacucuucggaauggccaaaaucgacaaccuccuacaagaaaugcuacucggcggcucccccuccgacgcaccccacgcccaucacccccuccacccacaccucaugcaagaacacaugggcaccaacguaauagucgccaacaccaugccaacccaccuaucaaacggucaaaugugcgaauggccuagaccccguggccaagccgccacgcccgaaacaccacagcccuccccacccggcggcuccggcucagaacccuacaaacuacuacccggagccgucgccacaaucguaaaaccccuaucggccaucccccaacccaccaucaccaaacaagaagucaucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 637 - RNA, 847 nt, Artificial Sequence
  mRNA product Design1 comprising derived and/or modified sequence from Homo sapiens__NP_061986.1__HsFGF21 (opt8)
gggagaaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 638 - RNA, 1573 nt, Artificial Sequence
  mRNA product Design1 comprising derived and/or modified sequence from Homo sapiens__NP_078852.3__HsOGFRL1 (opt8)
gggagaaagcuuaccaugggcaaccuacucggcggcgucucguuccgcgaaccaaccaccguagaggacugcgacagcaccuggcaaaccgacuccgaaccugaacccgaagaacccggccccggcggcggcagcgaaggccccggccaagaaucggaacaacccgcccaacccccagaacaagccggcggacgacccggcgccucacccgccccagacgaagacgcagaagccgccggggccgagcaaggcggcgacucuaccgaagccacagcuaaaccaaaacggagcuucuacgccgcccgcgaccucuacaaauaccgccaccaauaccccaacuucaaagacauccgcuaccaaaacgaccuauccaaucuucgcuuuuauaaaaacaaaauaccuuucaaacccgacggcgucuacaucgaagaaguucuaagcaaauggaaaggcgacuacgaaaaacucgaacacaaccacaccuacauccaauggcuauucccgcuacgcgaacaaggccugaacuucuaugccaaagaacuaaccaccuacgaaauagaagaguucaaaaaaaccaaagaagcaauacgccgcuuccuccuagccuacaaaaugaugcucgaauuuuucgggaucaaacuaaccgacaaaaccggcaacgucgcccgcgcuguaaauuggcaagaacgauuccaacaccuaaacgagucccagcacaacuaccuaagaaucacccgaauacucaaaucccucggagagcucggcuacgaauccuucaaauccccacucgucaaguucauccuccacgaggcccucgucgagaacaccauccccaacaucaaacaguccgcacuagaauacuucguguacaccauccgcgaccgccgugaacgacgcaaacuccuacgcuucgcccaaaaacacuacacacccuccgaaaacuucaucuggggcccacccagaaaagaacaauccgaaggauccaaagcccaaaaaauguccagcccacuagccagcucccauaacucacaaacaucaaugcacaaaaaggccaaagacucaaaaaacuccuccagcgccguacaccucaacuccaaaaccgccgaagacaaaaaagucgcccccaaggaacccgucgaagaaacagaccgcccaucgccagaacccucaaacgaagccgcaaaaccccgcaacaccgagaaagacucaaaugccgaaaauaugaacucgcaacccgagaaaacagucaccacccccacagaaaaaaaagaauccgugagcccagaaaacaacgaagaaggcggcaacgacaaccaagacaacgaaaacccuggaaacaccaacugccacgacgucguacucguacaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 639 - RNA, 775 nt, Artificial Sequence
  mRNA product Design1 comprising derived and/or modified sequence from Homo sapiens__NP_008842.1__HsRLN1 (opt8)
gggagaaagcuuaccaugccccgccucuuccucuuccaccuccuagaauuuugccuccuccucaaccaauucucccgcgccgucgccgccaaauggaaagacgacguuauaaaacucugcggccgcgaacucguccgcgcccaaaucgccaucugcggcaugucaaccugguccaaacgcucacucucacaagaagacgccccccaaaccccccgcccagucgccgaaaucgucccaucauucaucaacaaagacacagaaaccauaaucaucaugcucgaauuuauagccaaccucccccccgaacucaaagccgcccucuccgaacgacaacccucccuccccgaacuacaacaauacgucccagcccucaaagacucaaaccucucauuugaagaauuuaaaaaacuaauccgcaaccgacaauccgaagccgccgacuccaaccccuccgaacuaaaauaccucggccuugacacccacagccaaaaaaaacgcagacccuacgucgcacucuucgaaaaaugcugccucaucggaugcaccaaacgcucccucgccaaauacugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 640 - RNA, 775 nt, Artificial Sequence
  mRNA product Design1 comprising derived and/or modified sequence from Homo sapiens__NP_604390.1__HsRLN2 (opt8)
gggagaaagcuuaccaugccccgccucuucuucuuccaccuccucggcguaugccuccuccucaaccaauucucccgcgccgucgccgacuccuggauggaagaagucaucaaacucugcggacgcgaacucguccgcgcccaaaucgccauaugcggcauguccacuugguccaaacgcucccucucccaagaggacgcaccacaaaccccccgacccgucgcagaaaucgucccauccuucaucaacaaagacaccgaaacuaucaacaugaugucagaauuugucgcaaaccucccccaagaacuuaaacucacccucuccgaaaugcaacccgcccucccccaacuacaacaacacguccccguacuaaaagacuccucccuccucuuugaagaauuuaaaaaacuaauccgcaaccgccaaucagaagccgccgacagcucccccucagaacucaaauaccucggacucgacacacacucccgcaaaaaacgccaacuauacucagcacucgccaacaaaugcugccacgucggcugcaccaaacgcucacucgcccgauucugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 641 - RNA, 646 nt, Artificial Sequence
  mRNA product Design1 comprising derived and/or modified sequence from Homo sapiens__NP_543140.1__HsRLN3  (opt8)
gggagaaagcuuaccauggcgagauauauguugcuacugcucuuggccgugugggugcucacgggagagcucuggcccggggccgaggccagggccgcgcccuauggagugcgauugugcgggcgcgaguucauacgcgcgguaauauucacgugcgggggaucgcgcuggcgcaggagcgauaucuuggcccaugaagcgaugggggacacauucccggacgcagacgcggacgaggacucgcucgcgggcgagcucgaugaagcgauggggaguucggaauggcuagcgcuaacgaaaucgccccaggccuuuuacaggggcaggccaucauggcagggaacgcccgggguccugcgagggagcagggacguguuagcgggcuugagcucaagcuguugcaagugggggugcucgaaaucagaaauaagcucgcucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 642 - RNA, 1627 nt, Artificial Sequence
  mRNA product Design1 comprising derived and/or modified sequence from Homo sapiens__NP_002412.1__HsMMP1 (opt8)
gggagaaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 643 - RNA, 1387 nt, Artificial Sequence
  mRNA product Design1 comprising derived and/or modified sequence from Homo sapiens__NP_002412.1__HsMMP1(1-19,100-469) (opt8)
gggagaaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 644 - RNA, 3574 nt, Artificial Sequence
  mRNA product Design1 comprising derived and/or modified sequence from Clostridium histolyticum__BAA77453.1__ColG (opt8)
gggagaaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 645 - RNA, 3298 nt, Artificial Sequence
  mRNA product Design1 comprising derived and/or modified sequence from Clostridium histolyticum__BAA77453.1__HsALB(1-18)_ColG(111-1118) (opt8)
gggagaaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 646 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt8)
gggagaaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 647 - RNA, 3322 nt, Artificial Sequence
  mRNA product Design1 comprising derived and/or modified sequence from Clostridium histolyticum__BAA34542.1__ColH (opt8)
gggagaaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 648 - RNA, 3283 nt, Artificial Sequence
  mRNA product Design1 comprising derived and/or modified sequence from Clostridium histolyticum__BAA34542.1__ColH (opt8)
gggagaaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 649 - RNA, 3217 nt, Artificial Sequence
  mRNA product Design1 comprising derived and/or modified sequence from Clostridium histolyticum__BAA34542.1__HsALB(1-18)_ColH(41-1021) (opt8)
gggagaaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 650 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt8)
gggagaaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 651 - RNA, 1063 nt, Artificial Sequence
  mRNA product Design1 comprising derived and/or modified sequence from Homo sapiens__NP_003801.1__HsTNFSF10 (opt9)
gggagaaagcuuaccauggccaugauggaaguccaaggcggaccaucccucggccaaaccugcguccuaaucgucaucuucaccguccuccuccaaucacucugcguagccgucaccuacguauacuucacaaacgaacuaaaacaaaugcaggacaaauacuccaaauccggcaucgccugcuuccucaaagaagacgacuccuacugggacccaaacgacgaagaauccaugaacuccccaugcuggcaagucaaauggcaacuccgccaacucguccgcaaaaugauccuccgcaccagcgaagaaaccaucagcacaguacaagaaaaacaacaaaacaucagcccccucguacgcgagagaggaccccaacgcguagcagcccacaucacaggcaccagaggccgcuccaacacccucuccucccccaacuccaaaaacgaaaaagcccucggccgcaaaaucaacuccugggaaagcucccgcucaggccacucauucuuauccaaccuacaccuccgcaacggagaacucguaauccacgaaaaaggcuucuacuacaucuacucccaaaccuacuuccgcuuccaagaagaaaucaaagaaaacacuaaaaacgacaaacagaugguccaauacaucuacaaauacaccuccuaccccgaccccauacuccucaugaaaagcgccagaaacuccugcuggagcaaagacgccgaauacggccuauacuccaucuaccaaggcggcaucuucgaacucaaagaaaacgaccgaaucuucgucuccguaaccaacgaacaccuaaucgacauggaccacgaagccuccuucuucggagcuuuccucgucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 652 - RNA, 784 nt, Artificial Sequence
  mRNA product Design1 comprising derived and/or modified sequence from Homo sapiens__NP_003801.1__HsTNFSF10(95-281) (opt9)
gggagaaagcuuaccaugaccucagaagaaaccaucuccacaguccaagaaaaacaacaaaacauaagcccccucguccgcgaacgcggaccccaacgcguagccgcacacaucaccggaacccgcggccgauccaacacccucuccucacccaacuccaaaaacgaaaaagcccucggccgcaaaaucaacuccugggaaucaucccgcuccggccacuccuuccuaucaaaccuccaccuacgaaacggcgaacucgucauccacgaaaaaggcuucuacuacaucuacucccaaacauacuuccgauuccaagaagaaaucaaagaaaacaccaaaaacgacaaacaaaugguccaauacaucuacaaauacacauccuaccccgacccaauacuacucaugaaaagcgcccgcaacuccugcuggucaaaagacgccgaauacggacucuacuccaucuaccaaggcggcaucuucgaacugaaagaaaacgaccgcauauucguauccgucaccaacgaacaccucaucgacauggaccacgaagccagcuucuucggcgccuuucucgucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 653 - RNA, 835 nt, Artificial Sequence
  mRNA product Design1 comprising derived and/or modified sequence from Homo sapiens__NP_003801.1__HsALB(1-18)_HsTNFSF10(95-281) (opt9)
gggagaaagcuuaccaugaaauggguaacauucaucucccuccuauuccuauucuccuccgccuacuccaccuccgaagaaaccauauccacaguccaagaaaaacaacaaaacauaucaccccucguacgagaacgaggcccccaacgcgucgccgcacacaucaccggcacccgcggccgcuccaacacccucuccucacccaacuccaaaaacgaaaaagcccucggccgcaaaaucaacuccugggaauccucacgauccggccacuccuuccucucaaaccuccaccuccgcaacggcgaacucgucauccacgaaaaaggcuucuacuacaucuacucacaaacauacuuucgcuuccaagaagaaaucaaagaaaacaccaaaaacgacaaacaaaugguccaauacaucuacaaauacaccucuuaccccgacccaauccuccucaugaaaucagcccgcaacuccugcugguccaaagacgccgaauacggccucuacuccauauaccaaggcggcauauucgaacuaaaagaaaacgaccgaauauucgucuccguaaccaacgaacaccucaucgacauggaccacgaagccucauucuucggagccuuucucgucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 654 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt9)
gggagaaagcuuaccaugaaauggguaaccuucaucucccuccucuuccucuuuuccuccgccuacucccgcaugaaacaaauagaagacaaaaucgaagaaauccucuccaaaaucuaccacaucgaaaacgaaauagcacgaaucaagaaacuaauaggagaaaccuccgaagaaaccauauccaccguccaggaaaaacaacaaaacauaagcccccucguccgcgaacgcggaccccaacgcgucgccgcccacaucaccgggacccgaggccgauccaacacccugagcucacccaacagcaaaaacgaaaaagcacuaggccgcaaaaucaacuccugggaauccuccagauccggccacuccuuccuaagcaaccuccaccucagaaacggcgaacucguaauccacgaaaaaggcuucuacuacaucuacucacaaaccuacuuccgcuuccaagaagaaaucaaagaaaacaccaaaaacgacaaacaaaugguccaauacaucuacaaauacacaagcuaccccgacccaauccuccuaaugaaaagcgcccgcaacuccugcuggucaaaagacgccgaauacggacucuacuccauauaccaaggcggcaucuucgaacucaaagaaaacgaccgcaucuucgucuccgucacaaacgaacaccucauagacauggaccacgaagccuccuucuucggagccuuccucgucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 655 - RNA, 1294 nt, Artificial Sequence
  mRNA product Design1 comprising derived and/or modified sequence from Rattus norvegicus__NP_036656.1__RnCebpa (opt9)
gggagaaagcuuaccauggaauccgccgacuucuacgaagccgaaccccgacccccaaugucaagucaucuccaaagcccaccccacgcacccuccaacgccgccuucggauuccccagaggcgccggacccgcacccccaccagcaccacccgcagcacccgaaccccuaggagguaucugcgaacacgaaaccucaauagacaucuccgcauacauagacccagcagccuucaacgacgaguuccuagccgaccuauuccaacacagccgacaacaagaaaaagccaaagccgcagcaggacccgcaggaggaggcggagacuucgacuacccaggcgcaccagccggaccaggaggagcaguaauguccgccggagcccacggcccaccacccggcuacgggugcgcagccgcgggcuaucuugacggccgccucgaaccccucuacgaacgaguaggcgcacccgcccucagaccccucgucauaaaacaagaaccccgugaagaagacgaagcaaaacaacucgcccucgcaggccuauuccccuaccaacccccaccuccaccacccccaccccacccccacgcaagccccgcacaccuugcagcgccccaccuccaauuccaaauagcccacugcggacaaaccaccaugcaccuccaaccaggccaccccacaccaccacccaccccaguucccucaccccaccccgccccagccaugggagccgcaggccuacccggacccggaggaucccucaaaggccuagccggcccccacccagaucuccgaacaggaggcggaggaggaggcggagccggagcaggcaaagcgaagaaauccgucgacaaaaauuccaacgaauaccgagucagacgcgaacgcaacaacauagccguccgaaaaucccgagacaaagccaaacaaagaaacguagaaacacaacaaaaaguccucgaacuaacaagcgacaacgaccgccuacgcaaacgcgucgaacaacucucccgagaacuagacacccuacgcggaaucuuucgccaacuccccgaaucaagccuaguaaaagcuaugggcaacugcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 656 - RNA, 1252 nt, Artificial Sequence
  mRNA product Design1 comprising derived and/or modified sequence from Rattus norvegicus__NP_036656.1__RnCebpa(15-344) (opt9)
gggagaaagcuuaccaugucaucccaucuccaaucacccccccacgccccauccaacgccgccuucggcuucccgcggggcgcuggacccgcaccaccccccgcaccccccgccgcacccgaaccccucggcggcaucugcgaacacgaaaccucaauagacaucuccgcauacauagacccagcugccuucaacgaugaauuccuagccgaccucuuccaacacucccgccaacaagaaaaagcaaaagcagcagccggacccgcaggcggaggaggagacuucgacuacccaggagcuccagcaggacccggcggagcagucauguccgcaggcgcacacggacccccacccggcuacggaugcgcagccgcaggcuaccucgacggccgccucgaaccccuauacgaacgcguaggagccccagcccucagaccacucgucauaaaacaagaaccccgagaagaagacgaagccaaacaacuagcccucgccggccucuucccauaccaaccaccaccucccccaccccccccacacccccacgccucaccagcccaccuagccgcaccacaccuacaauuccaaauagcccacugcggucaaacuaccaugcaccuacaacccggccacccaacaccaccaccaacacccgucccauccccccaucccgcacccgcaaugggagccgccggccuacccggccccggaggcucacucaaaggccuagccggcccccaccccgaccuaagaaccggaggcggaggcggcggcggagccggcgccggaaaagcaaaaaaguccguagacaaaaacucaaacgaauaccgagucagacgagaacgcaacaacauagccguccgcaaaucaagagacaaggcaaaacaaagaaacguugaaacccaacagaaaguacucgaacuaaccagcgacaacgaccgccuccgcaaacgcguagaacaauuaucccgugaacuagacacccuccgaggcauauuccgccaacucccagaaucgucccuagucaaagccaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 657 - RNA, 1297 nt, Artificial Sequence
  mRNA product Design1 comprising derived and/or modified sequence from Mus musculus__NP_031704.2 __MmCebpa (opt9)
gggagaaagcuuaccauggaauccgccgacuucuacgaaguagaaccccgcccacccauguccucucaccuccaaucccccccccacgcaccauccaacgcagccuucggcuucccacgaggcgccggacccgcacccccccccgcacccccagcagcccccgaaccccuuggcggaaucugcgaacacgaaaccucaaucgacauuucagccuacauagaccccgccgcauucaacgacgaguuccuagccgaccucuuccaacacucccgccaacaagaaaaagcaaaagcagcagcaggaccagcaggcggcggaggcgauuucgacuaccccggcgcacccgcaggcccaggcggcgcagucauguccgccggugcccacggcccaccacccggcuacggcugcgccgccgccggcuaccucgacggcagacuagaaccccucuacgaacgugucggcgcccccgcccuacgaccacucgucaucaaacaagaaccucgcgaagaagacgaagcuaaacaacuagcccucgccggccuauucccauaccaacccccccccccgccaccccccccacacccacacgccucccccgcccaccucgcagcaccccaccuccaauuccaaauagcacacugcggccaaaccaccaugcacuuacaacccggacaccccaccccaccccccaccccagucccauccccccacgccgccccagcccucggcgcagccggccuccccggacccggcagcgcucucaaaggccucgccggcgcccaccccgaccuccgcaccggcggcggcgguggcggcucaggugccggcgcgggcaaagccaaaaaaagcguagacaaaaacucaaacgaauaccgcguccgacgcgaacgaaacaacaucgccguucgcaaaagccgagacaaagccaaacaacgcaacgucgaaacccaacaaaaaguacuagaacucacaucagacaacgaccgucuacgaaaacgagucgaacaacuaucacgagaacucgacacacuacgcggaaucuuccgacaacuucccgaaucaucccucguaaaagccaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 658 - RNA, 1255 nt, Artificial Sequence
  mRNA product Design1 comprising derived and/or modified sequence from Mus musculus__NP_031704.2 __MmCebpa(15-359) (opt9)
gggagaaagcuuaccauguccagccacuuacaaucacccccccacgcccccuccaacgccgcauucggcuuccccagaggcgccggcccagcacccccuccagcccccccagccgccccagaaccccuuggcggcaucugcgagcacgaaaccucuauagacaucucggcauacaucgaccccgccgccuucaacgacgaauucuuagccgaccuauuccaacacucccgccaacaagaaaaagccaaagccgcagccggacccgccggcggcggaggcgacuucgacuaccccggagcacccgccggccccgggggcgcaguaaugucagccggcgcacacggcccccccccaggcuacggaugcgccgccgccggauaccuagacggccgacucgaaccccucuaugaacgugucggcgcccccgcccuccgaccccuagucaucaaacaagaaccccgcgaagaagacgaagcaaaacaacucgcccucgccggccucuucccauaccaacccccaccccccccaccccccccccacccacacgccucucccgcccaccuagcagcuccccaccuccaauuccaaauagcucacugcggacaaaccacgaugcaccuacaacccggacaccccacuccacccccaacacccguaccuuccccacacgcagcacccgcccucggcgcagcaggccuacccggccccggaucagcccucaaaggccucgcaggcgcccacccagaccuacgaaccggaggcggcggcggcggcuccggagcuggcgccggcaaagccaaaaaaucaguagacaaaaacuccaacgaauaccgaguccgcagagaacgaaacaacaucgcaguccgcaaaucccgcgacaaagccaaacaacgaaacguugaaacacaacaaaaaguacuagaacucaccuccgauaacgaccgacuaagaaaacgagucgaacaacucucccgcgaacucgacacccuaagaggcaucuuccgacaacuccccgaauccucccucgucaaagcaaugggaaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 659 - RNA, 1294 nt, Artificial Sequence
  mRNA product Design1 comprising derived and/or modified sequence from Homo sapiens__NP_004355.2__HsCEBPA (opt9)
gggagaaagcuuaccauggaauccgcagacuucuacgaagccgaaccccgaccccccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 660 - RNA, 1252 nt, Artificial Sequence
  mRNA product Design1 comprising derived and/or modified sequence from Homo sapiens__NP_004355.2__HsCEBPA(15-358) (opt9)
gggagaaagcuuaccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 661 - RNA, 1642 nt, Artificial Sequence
  mRNA product Design1 comprising derived and/or modified sequence from Homo sapiens__NP_000448.3__HsHNF4A (opt9)
gggagaaagcuuaccaugcgccuaagcaaaacccuugucgacauggacauggcagacuacucagccgcacucgaccccgcauacacaacacucgaauuugaaaacguacaaguccuaacaaugggcaacgacacaucaccaagcgaagguaccaaucuaaacgcccccaacagccugggcgucucagcucuuugcgcaaucugcggcgaccgcgcaaccgguaaacacuacggcgccuccuccugcgacggcugcaaaggauucuuccgccguuccguucgcaaaaaccacauguacuccugccgauuuagccgacaaugcgucgucgacaaagacaaaagaaaccaaugccgcuauugccgccucaaaaaaugcuuccgcgccggaaugaaaaaagaagcaguccaaaacgaacgcgaccgcaucagcacacgacgaucguccuacgaagacuccucacuacccucaaucaaugcacuccuccaagccgagguccuaucccgacaaaucaccucacccgucuccggcauaaacggcgacauucgcgccaaaaaaaucgccuccaucgccgacgucugcgaguccaugaaagagcaacuccucguccucgucgaaugggccaaauacauccccgcauucugugaacucccccucgacgaccaagucgcccuacuucgcgcccacgccggcgaacaucuccuccuaggcgccaccaagcgguccaugguauucaaagacguccuacuccucggcaacgacuacaucgucccccgacauugcccagaacucgccgaaaugucacgagucuccauccgaauacuugacgaacucguccuacccuuccaagaacuccaaaucgacgacaacgaguacgccuaccuaaaagcaaucaucuucuucgaccccgacgccaaaggacugucagacccaggcaaaaucaaacgccuacgcucccagguucaagucucccuagaagacuauaucaacgaccgccaguacgacuccagaggccgauucggagaacuccuccuacuccuaccgacccuacaauccaucaccuggcaaaugaucgaacagauccaauucaucaaacuauucggaauggccaaaaucgacaaccuacuccaagaaaugcuucucggaggcuccccauccgacgccccccacgcccaccacccucuccacccccaccucaugcaggaacacaugggcaccaacgucaucgucgcaaacacuaugccuacccaccucuccaacggacaaaugugcgaauggccacgcccacgcggccaagccgccacacccgaaaccccacaaccauccccccccggcggaagcggcagcgaaccuuacaaacuccuacccggcgccgucgccacuauagucaaaccucucuccgccaucccacagcccaccaucaccaagcaagaagucaucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 662 - RNA, 847 nt, Artificial Sequence
  mRNA product Design1 comprising derived and/or modified sequence from Homo sapiens__NP_061986.1__HsFGF21 (opt9)
gggagaaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 663 - RNA, 1573 nt, Artificial Sequence
  mRNA product Design1 comprising derived and/or modified sequence from Homo sapiens__NP_078852.3__HsOGFRL1 (opt9)
gggagaaagcuuaccaugggcaaccuacuaggcggagucucauuccgcgaaccaaccaccguagaagacugcgacucaaccuggcaaaccgacuccgaaccagaaccggaggaacccggccccggcggagguagcgagggcccaggccaagaaagcgaacaaccagcccaaccacccgagcaagcaggaggacgccccggcgcaagccccgcacccgacgaagacgccgaagccgccggugccgaacaaggcggagacagcacagaagcaaccgcuaaacccaaacgcagcuucuacgcggcacgagaccuauacaaauaccggcaccaguacccaaacuucaaagacauccgauaccaaaacgaccucuccaaccucagauucuacaaaaacaagauccccuuuaaacccgacggagucuacaucgaagaaguauugagcaaauggaaaggcgacuacgaaaaacucgaacacaaccacacauacauacaauggcuauucccccuaagagaacaaggccugaacuucuacgcaaaagaacuaacaacauacgaaaucgaagaguucaaaaagacaaaagaagcaauccgcagauucuuacucgccuacaaaaugaugcuagaguucuucggcaucaaacuaacagacaaaacaggcaacgucgcccgagccgucaacuggcaggaacgcuuccaacaccucaacgaaucacaacacaacuaucuccggaucacccgaaucuuaaaaucacucggagaacuaggcuacgaaucguucaaaucaccccuaguuaaauucauccuccacgaagcccucguagaaaacaccauccccaacaucaaacaaagcgcgcuagaauacuucgucuacacaauccgcgaccgcagagaacgccgaaaacuacuccgcuucgcucagaaacacuacaccccaagcgaaaacuucaucuggggaccaccccgaaaagaacaauccgagggcuccaaagcccaaaagauguccagcccccucgcaucaucgcacaacagccaaaccucaaugcacaagaaagccaaagacuccaaaaacagcucaagcgccguccaccucaacagcaaaaccgcagaagacaagaaagucgccccaaaagaacccgucgaagagaccgaccgccccucacccgaacccagcaacgaagccgcaaaaccccgcaacaccgaaaaagacagcaacgccgaaaacaugaacucccaacccgagaaaaccguaacaacacccaccgaaaagaaagaaagcguauccccugaaaacaacgaagaaggaggaaacgacaaccaagacaacgaaaacccaggcaacacgaacugccacgacguaguccuaguacaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 664 - RNA, 775 nt, Artificial Sequence
  mRNA product Design1 comprising derived and/or modified sequence from Homo sapiens__NP_008842.1__HsRLN1 (opt9)
gggagaaagcuuaccaugccccgccuauuccucuuccaccuccuagaauuuugccuccuccucaaccaauucucccgcgccgucgccgccaaauggaaagacgacgucaucaaacucugcggccgcgaacucguacgcgcccaaaucgccauaugcggcauguccaccuggucaaaacgcucccucucccaagaagacgccccccaaacaccccgaccagucgcagaaaucguccccuccuucaucaacaaagacacagaaaccaucaucaucaugcucgaauuuaucgcaaaccucccccccgaacucaaagccgcccucuccgaacgccaacccucacuccccgaacuccaacaauacguccccgcccucaaagacuccaaccuuuccuucgaagaauuuaaaaaacuaauccgaaaccgucaaucagaagccgccgacuccaaccccuccgaacucaaauaccuaggccuagacacccacucccaaaaaaaacgacgacccuacgucgcccucuucgaaaaaugcugccucaucggcugcacaaaacgcucccucgcaaaauacugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 665 - RNA, 775 nt, Artificial Sequence
  mRNA product Design1 comprising derived and/or modified sequence from Homo sapiens__NP_604390.1__HsRLN2 (opt9)
gggagaaagcuuaccaugccccgccucuucuucuuccaccuccucggcgucugccuccuccuuaaccaguucucccgcgccguagccgacuccuggauggaagaagucaucaaacucugcggccgcgaacucguccgcgcacaaaucgccaucugcggaaugucaaccugguccaaacgcucacucucccaagaagacgccccccaaaccccccgcccugucgcagaaaucguccccuccuucaucaacaaagacaccgaaaccaucaacaugauguccgaauuugucgccaaccucccccaagaacucaaacucacccuaucagaaaugcaacccgcccuaccccaacuccaacagcacguacccguccucaaagacuccagccuccuauucgaagaauuuaaaaaacucauccgaaaccgacaauccgaagccgcagacucaucacccuccgaacuaaaauaucucggccucgacacccacucccgcaaaaaacgccaacucuacuccgcccucgccaacaaaugcugccacgucggcugcaccaaacgcucacucgcccgcuucugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 666 - RNA, 646 nt, Artificial Sequence
  mRNA product Design1 comprising derived and/or modified sequence from Homo sapiens__NP_543140.1__HsRLN3  (opt9)
gggagaaagcuuaccauggcgcgcuacaugcugcuauugcuccuggccgugugggugcucacgggcgagcucuggcccggggcagaggcaagggcagcgcccuauggagugcgauugugcgggcgagaguucauacgcgcggucauauucacgugcgggggaucacgauggcgcaggagcgauaucuuggcccaugaagcgaugggggacacguucccggacgcggacgcggacgaggacucgcuagcgggcgaacucgaugaagcgauggggagcucggaauggcucgcgcucacgaaaucgccacaggccuuuuacaggggcaggcccucguggcagggcacgcccggggucuugcgcgggaguagggacgugcucgcgggauugagcucgagcuguugcaagugggggugcucgaaaucggaaauaagcucgcuauguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 667 - RNA, 1627 nt, Artificial Sequence
  mRNA product Design1 comprising derived and/or modified sequence from Homo sapiens__NP_002412.1__HsMMP1 (opt9)
gggagaaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 668 - RNA, 1387 nt, Artificial Sequence
  mRNA product Design1 comprising derived and/or modified sequence from Homo sapiens__NP_002412.1__HsMMP1(1-19,100-469) (opt9)
gggagaaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 669 - RNA, 3574 nt, Artificial Sequence
  mRNA product Design1 comprising derived and/or modified sequence from Clostridium histolyticum__BAA77453.1__ColG (opt9)
gggagaaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 670 - RNA, 3298 nt, Artificial Sequence
  mRNA product Design1 comprising derived and/or modified sequence from Clostridium histolyticum__BAA77453.1__HsALB(1-18)_ColG(111-1118) (opt9)
gggagaaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 671 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt9)
gggagaaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 672 - RNA, 3322 nt, Artificial Sequence
  mRNA product Design1 comprising derived and/or modified sequence from Clostridium histolyticum__BAA34542.1__ColH (opt9)
gggagaaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 673 - RNA, 3283 nt, Artificial Sequence
  mRNA product Design1 comprising derived and/or modified sequence from Clostridium histolyticum__BAA34542.1__ColH (opt9)
gggagaaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 674 - RNA, 3217 nt, Artificial Sequence
  mRNA product Design1 comprising derived and/or modified sequence from Clostridium histolyticum__BAA34542.1__HsALB(1-18)_ColH(41-1021) (opt9)
gggagaaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 675 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt9)
gggagaaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 676 - RNA, 1063 nt, Artificial Sequence
  mRNA product Design1 comprising derived and/or modified sequence from Homo sapiens__NP_003801.1__HsTNFSF10 (opt11)
gggagaaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 677 - RNA, 784 nt, Artificial Sequence
  mRNA product Design1 comprising derived and/or modified sequence from Homo sapiens__NP_003801.1__HsTNFSF10(95-281) (opt11)
gggagaaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 678 - RNA, 835 nt, Artificial Sequence
  mRNA product Design1 comprising derived and/or modified sequence from Homo sapiens__NP_003801.1__HsALB(1-18)_HsTNFSF10(95-281) (opt11)
gggagaaagcuuaccaugaaaugggucaccuucaucucccuccuauuccucuucuccuccgccuacuccaccuccgaagaaaccaucuccaccguccaagaaaaacaacaaaacaucucaccccuuguccgcgaacgcggcccccaacgcguagccgcccacaucaccggcacccgcggccgcuccaacacccucuccucccccaacuccaaaaacgaaaaagcccucggccgcaaaaucaacuccugggaauccucccgcuccggccacucauuccucuccaaccuccaccuccgaaacggcgaacucgucauccaugaaaaaggcuucuacuacaucuacucccaaaccuacuuccgcuuccaagaagaaaucaaagaaaacaccaaaaacgacaaacaaaugguccaauacaucuacaaauacaccuccuaccccgacccaauccuacuaaugaaauccgcccgcaacuccugcugguccaaagacgccgaauacggacucuacuccauauaccaaggcggcaucuucgaacucaaagaaaacgaccgcaucuucgucuccgucaccaacgaacaccucaucgacauggaccacgaagccuccuucuucggcgccuuccucgucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 679 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt11)
gggagaaagcuuaccaugaagugggugaccuucaucucgcuccuguuccuguucucaagcgcguacucgcgcaugaaacaaaucgaagacaagaucgaggaaauacucucaaaaauauaccacaucgagaacgagaucgcgcgcauaaagaagcuaauaggcgagaccucggaagagaccauaagcacaguccaggaaaagcaacagaacauaagcccgcucgugcgcgagcgcggaccccagcgcguggccgcgcacauaaccgggacccggggccgcaguaacacccugagcucgcccaacagcaagaacgagaaagcacuagggcgaaaaaucaauagcugggaaucgagcagaagcgggcacucauuccuauccaaccuccaccucaggaacggggaacuggucauacacgagaaaggguucuacuacauauacucccaaacauacuuccgauuccaagaagaaauaaaagagaacacgaaaaacgacaagcaaaugguccaguacauauacaaauacacaagcuaccccgaccccauacucuugaugaaaagcgcacgcaacagcugcuggucgaaagacgccgaguacgggcucuacagcauauaccagggcggaaucuucgaacugaaagagaacgaccgcaucuucgugagcguaaccaacgaacaccucauagacauggaccacgaagcgagcuucuucggggccuuccuagugggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 680 - RNA, 1294 nt, Artificial Sequence
  mRNA product Design1 comprising derived and/or modified sequence from Rattus norvegicus__NP_036656.1__RnCebpa (opt11)
gggagaaagcuuaccauggaauccgcagacuucuacgaagccgaaccccgcccacccaugucaucccaccuccaaucaccaccccacgcacccucuaaugccgccuucggauucccccgcggcgccggacccgcacccccacccgcaccacccgccgcccccgaaccccucggaggaaucugcgaacacgaaaccagcaucgacaucucagccuacaucgaccccgccgcauucaacgacgaguuccucgccgaccuuuuccaacacuccagacaacaagaaaaagcaaaagccgcagccggacccgccggcggaggcggcgacuucgauuaccccggcgcccccgccggccccggcggcgcagucauguccgcaggagcccacggcccaccacccggcuacggcugcgccgccgcaggcuaccuagacggucgacuggaaccccucuacgaacgcgucggcgccccugcacuccgcccccucgucauaaaacaagaaccccgagaagaagacgaagccaaacaacucgcccucgccggccuauuccccuaccaaccacccccaccacccccacccccacacccacacgccucaccagcacaccuugccgcaccccaccuacaauuccaaaucgcccacugcggccaaacaacaaugcaccuacaaccuggccaccccaccccaccucccacacccguccccucaccccauccugcccccgccaugggagcagcaggccuacccggaccaggcggcucccuaaaaggccuagccggcccacaccccgaccuacgaacuggcggaggcggcggaggcggcgcaggcgcaggcaaagccaagaaauccgucgacaaaaacuccaacgaauaucgcguccgccgagaacgcaacaacauagccguccgcaaaucccgugacaaagccaaacaacgaaacguagaaacucaacaaaaaguccucgaacucacauccgacaacgaccgccucagaaaacgcgucgaacaacucucccgagaacucgacacccuccgcggcaucuuccgccaacuccccgaaucaucccucgucaaagcaaugggcaacugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 681 - RNA, 1252 nt, Artificial Sequence
  mRNA product Design1 comprising derived and/or modified sequence from Rattus norvegicus__NP_036656.1__RnCebpa(15-344) (opt11)
gggagaaagcuuaccaugucaucccaccuucaauccccaccccacgcccccuccaacgccgcauucggauucccccgaggagccggcccagcaccaccccccgccccaccagccgcccccgaaccccucggcggaauaugcgaacacgaaaccucaaucgacaucucagcguacauagacccagccgccuucaacgacgaauuccuagcggaccucuuccaacacuccagacaacaagaaaaagcaaaagccgccgccggacccgccggagguggaggagacuucgacuaccccggagcccccgccggacccggcggcgcaguaauguccgccggcgcacacggucccccccccggauacggcugcgcugccgccggcuaccuagacggcagacuagaaccacuauacgaacgcgucggcgccccagcccucagaccacuagucaucaaacaagaaccccgagaagaagacgaagcaaaacaacuagcccuagccggccuauuccccuaccaaccaccccccccaccaccccccccccacccccacgcaucccccgcccaccuagccgccccccaccuccaauuccaaauagcccacugcggccaaacaaccaugcaccuacaacccggacaccccacacccccccccacccccguccccucaccccaccccgcacccgccaugggcgccgccggccuccccggacccggcggcucccuaaaaggacuagccgguccccaccccgaccuccgcaccgggggaggaggcggcggcggcgccggagccggcaaagccaaaaaauccguugacaaaaacucaaacgaauacagagucagacgagaacgcaacaacauugccguccgcaaaucacgcgacaaagcaaaacaacgaaacgucgaaacacaacaaaaaguccucgaacucacuuccgacaacgaccgacuacgcaaacgcgucgaacaacucagccgcgaacucgacacacuccgcggcaucuuccgccaacuacccgaauccucccucguaaaagccaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 682 - RNA, 1297 nt, Artificial Sequence
  mRNA product Design1 comprising derived and/or modified sequence from Mus musculus__NP_031704.2 __MmCebpa (opt11)
gggagaaagcuuaccauggaaucagccgacuucuacgaagucgaaccacgccccccaaugucuucccaccuacaaucuccgccccacgcucccucaaacgcagccuucggcuucccacgcggcgccggacccgcccccccacccgccccucccgccgcacccgaaccccucggcggcaucugcgaacacgaaacauccaucgacauaagcgcauacauagaccccgcagcauucaacgacgaauuccucgccgaccucuuccaacacucgcgucaacaagaaaaagcaaaagccgcagccggccccgccggcggcggcggcgacuucgacuaccccggcgcccccgccggucccggaggagccguaaugucggcaggcgcccacggacccccccccggauacggaugcgccgccgccggcuaccuagacggacgccucgaaccccucuacgaaagagucggagcacccgcccuacgcccucucguaaucaaacaagaaccccgcgaagaagacgaagccaaacaacucgcccuagccggacucuuccccuaccaacccccccccccaccacccccaccccacccccacgcaucaccagcccaccuagccgccccccaccuacaauuccaaauagcacacugcggacaaaccaccaugcaccugcaaccaggacacccaacccccccacccaccccaguccccuccccccacgccgcccccgcacucggagccgccggccuacccggccccggcucagcacucaaaggccuugcaggcgcccacccagaccuacguacaggcggaggaggcggcggcuccggcgccggcgccggaaaagccaaaaaauccgucgacaaaaacuccaacgaauaccgcguccgccgcgaacgaaacaacaucgccgucagaaaaucccgcgacaaagcaaaacaacgcaacgucgaaacccaacaaaaaguccuagaauuaaccuccgacaacgacagacuucgcaaacgagucgaacaacuaucacgcgaacucgacacacuccgcggcauauuccgccaacucccagaaucaucccuugucaaagccaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 683 - RNA, 1255 nt, Artificial Sequence
  mRNA product Design1 comprising derived and/or modified sequence from Mus musculus__NP_031704.2 __MmCebpa(15-359) (opt11)
gggagaaagcuuaccaugucaucccaccuccaauccccaccccacgccccauccaacgcugccuucggauucccccgcggcgccggccccgcacccccacccgccccccccgcugcaccagaacccuuaggcggaauaugcgaacacgaaaccagcauagacaucucagcauacauugaccccgccgccuucaacgacgaauuccucgccgaccucuuccaacacagccgacaacaagaaaaagcaaaagccgcugcaggccccgccggcggcggcggcgacuucgacuaccccggcgccccagccggcccaggcggcgccgucaugucugcaggcgcccacggccccccacccggauacggaugugccgccgccggcuaucucgacggccgccuagaaccacucuacgaaagaguaggcgcccccgcccuccgcccccucgucaucaaacaagaacccagagaagaagacgaagccaaacaacucgcacucgccggccuguuccccuaccaaccccccccacccccaccccccccccacccacacgccucaccagcccaccucgccgccccccaccuccaauuccaaauagcccacugcggccaaaccaccaugcaccuccaaccgggccaccccaccccccccccaacccccguccccucuccccacgcagccccagcauuaggcgccgccggacuaccaggcccaggaucagcccuaaaaggacuagcaggcgcacaccccgaccuccgcacaggcggaggcggaggcggcagcggagccggcgccggaaaagccaaaaaaucagucgauaaaaacucaaacgaauacagaguccgacgcgaacgcaacaacaucgccguccgcaaaucaagagacaaagcuaaacaacgcaacguggaaacucaacaaaaaguccucgaacucaccucagacaacgaccgccuccgcaaacgcgucgaacaacucuccagagaacucgacacccuccgcggaaucuuucgacaacuccccgaauccucacucguaaaagcaaugggcaauugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 684 - RNA, 1294 nt, Artificial Sequence
  mRNA product Design1 comprising derived and/or modified sequence from Homo sapiens__NP_004355.2__HsCEBPA (opt11)
gggagaaagcuuaccauggaaagcgcagacuucuacgaagcagaaccccgaccccccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 685 - RNA, 1252 nt, Artificial Sequence
  mRNA product Design1 comprising derived and/or modified sequence from Homo sapiens__NP_004355.2__HsCEBPA(15-358) (opt11)
gggagaaagcuuaccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 686 - RNA, 1642 nt, Artificial Sequence
  mRNA product Design1 comprising derived and/or modified sequence from Homo sapiens__NP_000448.3__HsHNF4A (opt11)
gggagaaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgccuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 687 - RNA, 847 nt, Artificial Sequence
  mRNA product Design1 comprising derived and/or modified sequence from Homo sapiens__NP_061986.1__HsFGF21 (opt11)
gggagaaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 688 - RNA, 1573 nt, Artificial Sequence
  mRNA product Design1 comprising derived and/or modified sequence from Homo sapiens__NP_078852.3__HsOGFRL1 (opt11)
gggagaaagcuuaccaugggcaaccuccuaggcggagucucauuccgcgaacccaccacaguagaagacugcgacuccaccuggcaaacagacuccgaacccgaaccagaggaaccuggacccggcggcggaucggaaggacccggccaagaaagcgagcagcccgcacaaccacccgaacaagccgguggacgcccaggcgccucacccgccccagacgaggacgccgaagccgccggcgcagagcagggcggagacagcacugaagccacagcaaaaccuaaacgcuccuucuacgccgcccgagaccucuacaaauacagacaccaauaccccaacuucaaagacauucgauaccaaaacgaccucuccaaccuccgcuucuacaaaaacaaaaucccauucaaacccgacggagucuacauagaagaaguccucuccaaauggaaaggcgacuacgaaaaacuggaacacaaccacacauacauccaauggcucuuuccccuccgcgaacaaggccucaacuucuacgccaaagaacuaaccacauacgagaucgaagaauuuaaaaaaacuaaagaagccauacgccgcuuccuacucgccuacaaaaugaugcuagaguucuucggcaucaaacucaccgacaaaaccggcaacgucgcccgagccgucaacuggcaagaacgauuccaacaccucaacgaaucccaacacaacuaccuacgcauaacccgcauacuaaaaucccuuggcgaacucggauacgaauccuucaaauccccacuugucaaguucauccuccacgaagcucuagucgaaaacacaauaccaaacauaaaacaguccgcacucgaauacuucgucuacaccauccgcgaccgccgcgagcgccgcaaacuccuccgcuucgcccagaaacacuacacccccuccgaaaacuucaucuggggacccccaagaaaagaacaaucagaaggaucaaaagcucaaaagaugagcuccccacuagccucaucacacaacucccaaaccuccaugcacaaaaaagccaaagacucaaaaaauuccagcucagccguccaccucaacucaaaaaccgcagaggacaaaaaagucgcacccaaagaacccguagaagaaaccgaccgaccaucacccgaaccauccaacgaagcagccaaaccacgcaacacagagaaagacuccaacgccgaaaacaugaacucccaacccgaaaaaacagugaccacacccaccgaaaaaaaagaauccguaucccccgaaaacaacgaggaaggcggaaacgacaaccaagacaacgaaaaccccggcaacaccaacugccaugacgucguccuaguccaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 689 - RNA, 775 nt, Artificial Sequence
  mRNA product Design1 comprising derived and/or modified sequence from Homo sapiens__NP_008842.1__HsRLN1 (opt11)
gggagaaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgccccccaaaccccccgccccgucgccgagaucguccccuccuucaucaacaaagacaccgaaaccaucaucaucaugcucgaauuuaucgccaaccucccccccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugccuaaucggcugcaccaaacgcucccucgccaaauacugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 690 - RNA, 775 nt, Artificial Sequence
  mRNA product Design1 comprising derived and/or modified sequence from Homo sapiens__NP_604390.1__HsRLN2 (opt11)
gggagaaagcuuaccaugccccgccucuucuucuuccaccuccucggcgucugccuccuccuaaaccaauucucccgagccgucgccgacuccuggauggaagaagucaucaaacuaugcggccgcgaacucguccgcgcccaaaucgccaucugcggcauguccaccugguccaaacgcucccucucccaagaagacgccccccaaaccccccgccccgucgccgaaaucguccccuccuucaucaauaaagacaccgaaaccauaaacaugauguccgaauuugucgcaaaccucccccaagaacucaaacucacccucuccgaaaugcaacccgcccucccccaacuacaacaacacguccccguccucaaagacuccucccuacucuucgaagaauuuaaaaaacucauccgcaaccgccaaucagaagccgccgacuccuccccauccgaacucaaauaccucggccucgacacccacucccgaaaaaaacgccaacucuacagcgcccucgccaacaaaugcugccacgucggcugcaccaaacgcucccucgcccgcuucugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 691 - RNA, 646 nt, Artificial Sequence
  mRNA product Design1 comprising derived and/or modified sequence from Homo sapiens__NP_543140.1__HsRLN3  (opt11)
gggagaaagcuuaccauggcgcgcuauauguugcuauugcucuuggccgugugggugcucacgggcgagcucuggcccggggccgaggccagggccgcgcccuauggcgugcgcuugugcgggcgcgaguucauacgagcggucauauucacgugcgggggcucgcgcuggcgcaggagcgauauauuggcccaugaagcgaugggggacacguucccggacgcggacgcggacgaggacucgcucgcgggcgagcucgaugaagcgauggggagcucggaauggcuagcgcuaacgaaaucgccccaggccuuuuacaggggcaggcccucguggcagggaacgcccgggguauugcgagggagcagggacgugcucgcgggcuugagcucaagcuguugcaagugggggugcucgaaaucggaaauaagcucgcucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 692 - RNA, 1627 nt, Artificial Sequence
  mRNA product Design1 comprising derived and/or modified sequence from Homo sapiens__NP_002412.1__HsMMP1 (opt11)
gggagaaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 693 - RNA, 1387 nt, Artificial Sequence
  mRNA product Design1 comprising derived and/or modified sequence from Homo sapiens__NP_002412.1__HsMMP1(1-19,100-469) (opt11)
gggagaaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 694 - RNA, 3574 nt, Artificial Sequence
  mRNA product Design1 comprising derived and/or modified sequence from Clostridium histolyticum__BAA77453.1__ColG (opt11)
gggagaaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 695 - RNA, 3298 nt, Artificial Sequence
  mRNA product Design1 comprising derived and/or modified sequence from Clostridium histolyticum__BAA77453.1__HsALB(1-18)_ColG(111-1118) (opt11)
gggagaaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 696 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt11)
gggagaaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 697 - RNA, 3322 nt, Artificial Sequence; identical to SEQ ID NO: 469
  mRNA product Design1 comprising derived and/or modified sequence from Clostridium histolyticum__BAA34542.1__ColH (opt11)

SEQ ID NO: 698 - RNA, 3283 nt, Artificial Sequence
  mRNA product Design1 comprising derived and/or modified sequence from Clostridium histolyticum__BAA34542.1__ColH (opt11)
gggagaaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 699 - RNA, 3217 nt, Artificial Sequence
  mRNA product Design1 comprising derived and/or modified sequence from Clostridium histolyticum__BAA34542.1__HsALB(1-18)_ColH(41-1021) (opt11)
gggagaaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 700 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt11)
gggagaaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 701 - RNA, 1063 nt, Artificial Sequence
  mRNA product Design1 comprising derived and/or modified sequence from Homo sapiens__NP_003801.1__HsTNFSF10 (opt12)
gggagaaagcuuaccauggcaaugauggaaguacaaggaggacccagccuaggacaaacaugcguacuaauaguaauauucacaguacuacuacaaucacuuugcguugcaguaacauacguauacuucacaaacgaacuaaaacaaaugcaagacaaauacucaaaaucaggaauagcaugcuucuuaaaagaagaugacucuuacugggacccaaacgacgaagaaagcaugaauagccccugcuggcaaguaaaauggcaacuaagacaacucguacgaaaaaugauacuacgaacaucagaagaaacaauaucaacaguacaagaaaaacaacaaaacauauccccauuaguaagagaaagaggaccacaaagaguagcagcacacauaacaggaacaagaggaagaucaaacacacuaucaaguccaaacaguaaaaacgaaaaagcacuaggaagaaaaauaaacagcugggaaaguaguagaucaggacacucauuccuaucaaaccuacaccuaagaaacggagaauuaguaauccaugaaaaaggauucuacuacauauacucacaaacauauuucagauuccaagaagaaauaaaagaaaauacuaaaaacgacaaacaaaugguccaauauauauacaaauauacaucauacccagacccaauacuacuaaugaaaucagcaagaaacucaugcuggucaaaagaugcagaauauggacuauacucaauauaccaaggaggaauauucgaacuaaaagaaaaugacagaauauuuguaucaguaacaaacgaacaccuaauagacauggaccacgaagcaucauuuuucggcgccuuccuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 702 - RNA, 784 nt, Artificial Sequence
  mRNA product Design1 comprising derived and/or modified sequence from Homo sapiens__NP_003801.1__HsTNFSF10(95-281) (opt12)
gggagaaagcuuaccaugacaucagaagaaacaauaagcacaguacaagaaaaacaacaaaacauaucaccacuuguaagagaaagaggaccacaaagaguagcagcacacauaacaggaacaagaggaagaucaaacacacuaagcucaccaaacucaaaaaacgaaaaagcacuaggaagaaaaauaaacucaugggaaucaagcagaucaggacacucauuccuaucaaaccuacaccuaagaaacggagaacuuguaauacacgaaaaaggauucuacuacauauacucacaaacauacuucagauuccaagaagaaauaaaagaaaacacaaaaaacgacaaacaaaugguacaauacauauacaaauacacaucauacccagacccaauacuacuaaugaaaagcgcaagaaacagcuguuggucaaaagaugcagaauacggacuauacucaauauaccaaggaggaaucuucgaauuaaaagaaaacgacagaauauucguaucaguaacaaacgaacaccuaauagacauggaccacgaagcaucauucuucggagcauuccuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 703 - RNA, 835 nt, Artificial Sequence
  mRNA product Design1 comprising derived and/or modified sequence from Homo sapiens__NP_003801.1__HsALB(1-18)_HsTNFSF10(95-281) (opt12)
gggagaaagcuuaccaugaaauggguaacauucauaucacuacuauuccuauucucaagcgcauacucaacaucagaagaaacaauaucaacaguacaagaaaaacaacaaaacauaucaccauuaguaagagaaagaggaccacaaagaguagcagcacacauaacaggaacaagaggaagaagcaacacacuaagcucaccaaacaguaaaaacgaaaaagcacuaggaagaaaaauaaacucaugggaaucaucaagaucaggacacucauuccuaucaaaccuacaccuaagaaacggagaauuaguaauacacgaaaaaggauucuacuauauauacucacaaacauacuucagauuccaagaagaaauaaaagaaaacaccaaaaacgacaaacaaaugguacaauacauauacaaauacacaucauacccagacccaauacuacuaaugaaaagcgcaagaaacucaugcuggucaaaagacgcagaauacggacuauacagcauauaccaaggaggaauauucgaacuaaaagaaaacgacagaauauucguaucagucacaaacgaacacuuaauagacauggaccacgaagcaucauucuucggagcauucuuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 704 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt12)
gggagaaagcuuaccaugaaauggguaacauucauaucgcuacuauucuuauucucaagcgcauacucaagaaugaaacaaauagaagacaaaauagaagaaauacucucaaaaauauaccauaucgaaaacgaaauagcaagaauaaaaaaacuaauaggcgaaacuucagaagaaacaauaagcacaguacaagaaaaacaacaaaacauaagcccacuuguaagagaaagaggaccacaaagaguagcagcacauauaacaggaacaagaggaagaagcaacacacuaagcucaccaaacaguaaaaacgaaaaagcacuuggacgaaaaauaaauagcugggaaucaucaagaagcggacacucguuccuaagcaaccuacaccuaagaaacggagaacuuguaauacacgaaaaaggauucuacuacauauacucacaaacauauuuuagauuccaagaagaaauaaaagaaaacacaaaaaacgacaaacaaaugguacaauacauauacaaauacacaucauacccagacccaauacuccuaaugaaaagcgcaagaaacagcugcuggucaaaagaugcagaauacggacuauacagcauauaccaaggaggaauauuugaacuaaaagaaaacgauagaauauucguaaguguaacaaacgaacaccuaauagacauggaccacgaagcuagcuucuucggagcauuccuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 705 - RNA, 1294 nt, Artificial Sequence
  mRNA product Design1 comprising derived and/or modified sequence from Rattus norvegicus__NP_036656.1__RnCebpa (opt12)
gggagaaagcuuaccauggaaucagcagacuuuuaugaagcugaaccaagaccccccaugucaucccacuuacaaucacccccacaugcuccaucaaacgcagcauuuggauucccaaggggagcaggcccugcaccaccaccagcaccaccagcagcaccagaaccauuaggagguauuugugaacacgaaacaucaauagacauauccgcuuauauagauccagcagcauuuaaugaugaauuucuagcagaucuuuuucaacauaguagacaacaagaaaaagcaaaagcagcagcugguccagcuggaggaggaggagacuucgauuauccaggagcaccugcagggccuggaggagcggucaugagugcaggugcacauggaccaccuccaggauauggaugugcagcagccggauauuuagauggaagacuagaaccauuauaugaaagaguaggcgcaccagcauuaagaccauuaguaauaaaacaagaaccaagagaagaagacgaagcaaaacaauuagcacuagcaggacuauucccauaucaaccuccaccuccaccaccaccaccacacccacaugcaucaccagcacauuuagcagcaccacauuuacaauuucaaauugcacauuguggacaaacaacaaugcauuuacaaccaggacauccaacaccaccaccaacaccaguaccuucaccacauccagcaccagcaaugggcgcagcagguuuaccaggaccaggaggaaguuuaaaaggcuuagcugguccucauccagaccuaagaaccggaggaggaggaggaggaggagcaggagcaggaaaagcaaaaaaaaguguagauaaaaauucaaaugaauauagaguaagaagagaaagaaacaauauagcaguaagaaaaucuagagauaaagcgaaacaaagaaauguagaaacacaacaaaaaguguuagaacuaacaucagacaacgauagauuaagaaaaagaguagaacaauuaucgagagaacuugauacccuacgaggaauauuucgacaauuaccugaaucaucauuaguaaaagcaauggguaauugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 706 - RNA, 1252 nt, Artificial Sequence
  mRNA product Design1 comprising derived and/or modified sequence from Rattus norvegicus__NP_036656.1__RnCebpa(15-344) (opt12)
gggagaaagcuuaccaugucaucacaucuacaaucaccaccucaugcaccuucaaaugcagccuuuggauucccaagaggagcaggaccagcaccaccaccagcaccaccagcagcaccagaaccauuaggaggaauaugcgaacaugaaacaucaaucgauauauccgcauauauagauccagcagcauucaaugaugaauuuuuagcagauuuauuucaacauagucgacaacaagaaaaagcaaaagcagcagcaggcccagcaggcggcggaggagacuuugauuacccuggagcaccagcuggacccggaggagcaguaaugucagcaggagcacaugguccaccaccaggauauggaugcgcagcagcaggauacuuagauggaagacuagaaccauuauaugaaagaguaggagcaccugcauuaagaccauuaguuaucaaacaagaaccaagagaagaagaugaagcaaaacaauuagcauuagcaggacuauuuccauaucaaccaccaccaccaccaccaccaccacauccacaugcaucaccagcucaucuagcagcaccucauuuacaauuucaaauagcacauuguggucaaacaacaaugcaucuacaaccaggacauccaacaccaccaccaacuccaguuccaucaccacauccagcaccagcaaugggagcagcaggacuaccaggaccaggaggaucauuaaaaggacuagcaggaccacauccugaucuaaggacaggcggcggaggaggaggaggugcaggagcuggaaaagcuaaaaaaucaguagauaaaaauucaaacgaauauagaguaagacgcgaaagaaauaauauugcgguacgaaaaucaagagauaaagcaaaacaacgaaauguagaaacacaacaaaaaguacuagaauuaacaagugauaacgaccgucuaagaaaaagaguagaacaacuaucaagagaauuagauacucuaagagguaucuuuagacaacuaccagaaucaucauuaguuaaagcaaugggaaacugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 707 - RNA, 1297 nt, Artificial Sequence
  mRNA product Design1 comprising derived and/or modified sequence from Mus musculus__NP_031704.2 __MmCebpa (opt12)
gggagaaagcuuaccauggaaucagcagacuuuuaugaaguagaaccuagaccaccaaugaguucacauuuacaaucaccaccacaugcuccaucaaaugcagccuuuggauuuccuagaggagcaggaccagcaccaccaccagcuccaccagcugcaccagaaccauuaggaggaauaugugaacaugaaacaucaauagauauaucagcauacauagacccagcugcauuuaaugacgaauuucuagcugaucuuuuccaacacucaagacaacaagaaaaagcaaaagcagcagcuggaccagcaggaggaggaggagauuuugauuauccuggagcaccagcaggaccuggaggagcaguaaugucagcuggugcacauggaccuccaccaggauacgguugugcagcagcaggcuacuuagacggacgauuagaaccauuauacgaaagaguaggcgcuccagcacuuagaccuuuagucauuaaacaggaaccaagagaagaagaugaagcaaaacaacuagcuuuagcaggacuauuuccauaucaaccacccccaccaccaccaccuccacacccacaugcaucaccugcacaucuagcugcaccacauuuacaauuccaaauagcacauuguggucaaacaaccaugcauuuacaacccggacauccaaccccaccuccaacacccguuccuucuccacaugcagcaccagcacuaggagcagcagguuuaccaggacccggaagugcauuaaaaggauuagcaggagcacauccagauuuaagaacuggcgguggugguggaggaaguggagcuggugcaggaaaagccaaaaaaucaguagauaaaaauucuaacgaauauagaguaagaagagaaagaaauaauauugcuguaagaaaaucaagagauaaagccaaacaaagaaauguagaaacacaacaaaaaguauuagaauuaacaagcgauaaugauagguuaagaaaaagaguagaacaacugucuagagaauuagauacauuaagaggaauauuuagacaacuaccagaauccucacuaguaaaagcaaugggcaauugcgcuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 708 - RNA, 1255 nt, Artificial Sequence
  mRNA product Design1 comprising derived and/or modified sequence from Mus musculus__NP_031704.2 __MmCebpa(15-359) (opt12)
gggagaaagcuuaccaugaguagccacuuacaaucaccaccacaugcaccaucaaaugccgcauuuggauucccacgaggugcagguccagcaccaccuccagcaccaccagcagcaccagaaccauuaggaggaauuugugaacaugaaacaucaauagauauuucagcauauauagauccugcagcauuuaaugaugaauuuuuagcagauuuauuucaacauaguagacaacaagaaaaagcaaaagcagcugcuggcccagcaggaggaggcggagauuucgauuauccuggagcaccagcaggaccuggaggagcaguaaugagugcaggugcacacggaccacccccaggauauggaugugcagcagcaggauacuuagaugguagauuagaaccauuauaugaaaggguaggugcaccagcacuaagaccauuaguaauaaaacaagaaccaagagaagaagacgaagcaaaacaauuagcauuagcuggauuauuucccuaccaaccacccccaccaccaccuccaccacacccacaugcuucaccagcucauuuagcagcaccucauuuacaauuucaaauagcucauugcggacaaacaacaaugcaucuacaaccaggacauccaacaccaccuccaacaccaguaccaucaccucaugcugcaccagcacuaggugcagcuggauuacccggaccaggaucagcauuaaaaggauuagcaggagcucauccagauuuaagaacagguggaggagguggugguucuggagcaggagcagguaaagcaaaaaaaaguguagauaaaaauaguaacgaauacagaguaagaagagaacgaaauaauauagcaguuagaaaaucaagagauaaagcaaaacaaagaaauguagaaacacaacaaaaaguccuagaauuaacaucagauaaugacagauuaagaaaaagaguagaacaauuaucacgagaacuugauacauuaagaggaauauuuagacaauuaccugaauccucucuaguaaaagcaaugggaaauugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 709 - RNA, 1294 nt, Artificial Sequence
  mRNA product Design1 comprising derived and/or modified sequence from Homo sapiens__NP_004355.2__HsCEBPA (opt12)
gggagaaagcuuaccauggaaagcgcugauuuuuaugaagcagaaccaagaccaccaaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 710 - RNA, 1252 nt, Artificial Sequence
  mRNA product Design1 comprising derived and/or modified sequence from Homo sapiens__NP_004355.2__HsCEBPA(15-358) (opt12)
gggagaaagcuuaccaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 711 - RNA, 1642 nt, Artificial Sequence
  mRNA product Design1 comprising derived and/or modified sequence from Homo sapiens__NP_000448.3__HsHNF4A (opt12)
gggagaaagcuuaccaugagacuaucaaaaacauuagucgacauggauauggcagacuacuccgcugcauuagauccagcauacacaacacuugaauuugaaaacguacaaguacuaacgaugggaaacgacaccucaccaagcgaaggaaccaauuuaaacgcacccaauucauuaggaguuucagcauuaugcgcaauaugcggagauagagcaacagggaaacauuauggagccucaaguugcgacggauguaaagguuucuucagaagaucaguaagaaaaaaccacauguacucaugcagauuuucuagacaaugcguaguagacaaagauaaacgaaaucaaugcagauauuguagauuaaaaaaauguuucagagcaggaaugaaaaaagaagcuguccaaaaugaacgagaucgaauaagcacacgacgauccucauaugaagauucaucacuaccauccauaaacgcauuacuacaagcagaagucuuaucaagacaaauaacaucaccaguaucaggaaucaacggagauauaagagcaaaaaaaauugcaucaauagcagauguaugcgaaucaaugaaagaacaauuacuuguccuuguagaaugggccaaauacauaccagcauuuugugaacuaccacuagacgaucaaguagcauuauuaagagcacacgccggagaacacuuauuacucggagcaacaaaaagauccaugguauuuaaagacguacuuuuacuaggcaaugauuacauaguaccucgucacuguccagaacuagcagaaaugucacgaguaucaauaagaauccuagaugaacuuguacuaccauuccaagaauuacaaauagacgacaacgaauacgcauaccucaaagcuauaauauucuuugacccagacgcaaaaggcuuaucugauccaggaaaaaucaaaagauuaagaucacaaguacaaguaucauuagaagacuacauaaacgauagacaauacgauucaagaggcagauuuggagaacuauuauuacuacuacccacacuacaaucuauaacauggcaaaugauugagcaaauacaguuuauaaaacuauucggaauggcaaaaauagacaaccuauuacaagaaaugcuacuaggaggcucaccaagugaugccccccacgcacaccauccacuccacccacaccucaugcaagaacacaugggaacaaauguuauaguagcaaacacuaugccaacccacuuaucuaauggacaaaugugcgaauggccaagaccacguggucaagcagcgacaccugaaacaccacaaccaaguccaccaggcgguucaggaucagaacccuauaaauuauuacccggagccguagcaacaauaguaaaaccacuaucugcuauaccacaaccaacaauaacaaaacaagaaguaauauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 712 - RNA, 847 nt, Artificial Sequence
  mRNA product Design1 comprising derived and/or modified sequence from Homo sapiens__NP_061986.1__HsFGF21 (opt12)
gggagaaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 713 - RNA, 1573 nt, Artificial Sequence
  mRNA product Design1 comprising derived and/or modified sequence from Homo sapiens__NP_078852.3__HsOGFRL1 (opt12)
gggagaaagcuuaccaugggaaacuuauuaggaggaguaucauuccgagaaccuacgaccguugaagacugcgacucaacauggcaaacagacucugaaccagaaccagaagaaccuggaccaggcggaggaagcgaaggcccaggacaagaauccgaacaaccagcacaaccaccagaacaagcaggaggaagaccuggagcaucgcccgccccagaugaagacgcagaagccgcaggagcagaacaaggaggcgacuccacagaagccacagcaaaaccaaaacgaucauucuacgcugcacgcgaucuauacaaauauagacaccaauauccaaacuucaaagauauaagauaccaaaaugacuuaagcaacuuacgguucuacaaaaacaaaaucccauuuaaaccagacggaguauacauagaagaaguacuaucaaaauggaaaggagacuacgaaaaacuagaacacaaccacacauacauacaaugguuauucccuuuaagagaacaaggacucaauuucuaugcaaaagaacuaaccacauacgaaauugaagaauuuaaaaaaacaaaagaagcaaucagaagauucuuacuagcauacaaaaugaugcuagaauuuuuuggaauaaaacucacagacaaaacaggaaacguagccagagcaguuaacuggcaagaacgcuuucaacaucuaaacgaaucacaacacaacuaucucagaauaacaagaauacuaaaaucacugggagaauuaggcuacgaaucauuuaaaucaccacuuguaaaauucauauuacacgaagcacucguagaaaacacaauaccaaauauaaaacaaucugcccucgaauauuuugucuacaccaucagagauagacgcgaaagaagaaaauuauuacgauucgcacaaaaacauuacacaccaucagaaaacuucauauggggaccaccaagaaaagaacaauccgaaggaaguaaagcacaaaaaaugucaucaccacuagcauccucacacaacagucaaacaagcaugcacaaaaaagcaaaagacagcaaaaacucaucaagugcaguacaccuaaacucaaaaacagcagaagauaaaaaaguagcuccuaaagaaccgguugaagaaacagaucgaccaucaccagaaccaagcaacgaagcagcaaaaccuagaaacacagaaaaagacucaaaugcagaaaacaugaauagccaaccugaaaaaacaguaaccacaccaacagaaaaaaaagaaaguguaaguccagaaaacaaugaagaaggagguaacgacaaucaagauaacgaaaacccaggcaauaccaacugucaugacguaguucuaguacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 714 - RNA, 775 nt, Artificial Sequence
  mRNA product Design1 comprising derived and/or modified sequence from Homo sapiens__NP_008842.1__HsRLN1 (opt12)
gggagaaagcuuaccaugccaagacuauucuuauuccacuuacuagaauuuugccuacuacuaaaccaauucucaagagcagucgcagcaaaauggaaagacgacguaauaaaacuaugcggaagagaacuuguaagagcacaaauagcaauaugcggaauguccacauggucaaaaagaucacuaucacaagaagacgcaccacaaacaccaagaccaguagcagaaauaguaccuagcuucauaaacaaagacacagaaacaauaauaauaauguuagaauuuauagccaaccuaccacccgaacuaaaagcagcauuaagcgaaagacaaccaucauuaccagaauuacaacaauacguaccagcacuaaaagacucaaaccuaucauucgaagaauuuaaaaaauuaauaagaaacagacaaucagaagcagcagauucaaacccaucagaacuaaaauaccuaggacuagacacacacucacaaaaaaaaagaagaccauacguagcacuauucgaaaaaugcugccuaauaggaugcacaaaacgaucauuagcaaaauacugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 715 - RNA, 775 nt, Artificial Sequence
  mRNA product Design1 comprising derived and/or modified sequence from Homo sapiens__NP_604390.1__HsRLN2 (opt12)
gggagaaagcuuaccaugccaagacuauucuucuuccacuuacuaggaguaugcuuacuacuaaaccaauucucaagagcaguagcagacucauggauggaagaaguaauaaaacuaugcggcagagaacuuguaagagcacaaauagcaauaugcggaaugucaaccuggucaaaaagaucacuaucacaagaagacgcaccacaaacaccacgaccaguagcagaaauaguaccaucauucauaaacaaagacacagaaacaauaaacaugaugucagaauuuguagcaaacuuaccccaagaacuaaaauuaacauuaucagaaaugcaaccagcacuaccacaacuacaacaacacguaccaguacuaaaagacucaucacuacuauucgaagaauuuaaaaaacuaauaagaaacagacaaucagaagcagcagacucaucaccaucagaauuaaaauaccuaggacuagacacacacagcagaaaaaaacgacaacuauacagcgcacuagcaaacaaaugcugccacguaggaugcacaaaaagaucacuagcaagauucugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 716 - RNA, 646 nt, Artificial Sequence
  mRNA product Design1 comprising derived and/or modified sequence from Homo sapiens__NP_543140.1__HsRLN3  (opt12)
gggagaaagcuuaccauggcaagguauauguuauuauuauuacuagcaguauggguauuaacaggagaauuauggccaggagcagaagcaagagcagcaccauauggagugagauuauguggaagagaauuuauaagagcaguaauauuuacauguggaggaaguagauggagaagaagugauauauuagcacaugaagcaaugggagauacauuuccagaugcagaugcagaugaagauucauuagcaggagaauuagaugaagcaaugggaaguagugaaugguuagcauuaacaaaaagcccacaagcauuuuauagaggaagaccaaguuggcaaggaacaccaggaguauuaagaggaaguagagauguauuagcaggauuaaguaguaguuguuguaaauggggauguaguaaaagugaaauaaguaguuuauguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 717 - RNA, 1627 nt, Artificial Sequence
  mRNA product Design1 comprising derived and/or modified sequence from Homo sapiens__NP_002412.1__HsMMP1 (opt12)
gggagaaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 718 - RNA, 1387 nt, Artificial Sequence
  mRNA product Design1 comprising derived and/or modified sequence from Homo sapiens__NP_002412.1__HsMMP1(1-19,100-469) (opt12)
gggagaaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 719 - RNA, 3574 nt, Artificial Sequence
  mRNA product Design1 comprising derived and/or modified sequence from Clostridium histolyticum__BAA77453.1__ColG (opt12)
gggagaaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 720 - RNA, 3298 nt, Artificial Sequence
  mRNA product Design1 comprising derived and/or modified sequence from Clostridium histolyticum__BAA77453.1__HsALB(1-18)_ColG(111-1118) (opt12)
gggagaaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 721 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt12)
gggagaaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 722 - RNA, 3322 nt, Artificial Sequence
  mRNA product Design1 comprising derived and/or modified sequence from Clostridium histolyticum__BAA34542.1__ColH (opt12)
gggagaaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 723 - RNA, 3283 nt, Artificial Sequence
  mRNA product Design1 comprising derived and/or modified sequence from Clostridium histolyticum__BAA34542.1__ColH (opt12)
gggagaaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 724 - RNA, 3217 nt, Artificial Sequence
  mRNA product Design1 comprising derived and/or modified sequence from Clostridium histolyticum__BAA34542.1__HsALB(1-18)_ColH(41-1021) (opt12)
gggagaaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 725 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt12)
gggagaaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 726 - RNA, 1063 nt, Artificial Sequence
  mRNA product Design1 comprising derived and/or modified sequence from Homo sapiens__NP_003801.1__HsTNFSF10 (opt13)
gggagaaagcuuaccauggcaaugauggaaguccaaggaggacccucacuaggacaaacaugcguacuaauaguaauauucacaguacuacuacaaucacuaugcguagcaguaacauacgucuacuuuacaaacgaacuuaaacaaaugcaagauaaauacucaaaaucaggaauagcaugcuucuuaaaagaagaugacucauacugggacccaaacgacgaagaaucaaugaauagcccaugcuggcaaguaaaauggcaacuaagacaacuuguaagaaaaaugauacuaagaacaucagaagaaacaauaucaacaguacaagaaaaacaacaaaacauaucaccauuaguaagagaaagaggcccacaacgcguagcagcacacauaacaggaacaagaggaagaucaaacacacuaucaucaccaaauucaaaaaaugaaaaagcauuaggacgaaaaaucaacucaugggaaucaucaagaucaggacauucauucuuaaguaaucuacacuuacgaaacggagaauuaguaauacacgaaaaaggauucuacuacauauacucacaaacauacuucagauuccaagaagaaauaaaagaaaacacaaaaaacgacaaacaaaugguacaauacauauauaaauauacaagcuacccagacccaauauuauuaaugaaaagugcaagaaauagcugcuggucaaaagacgcagaauauggacuauacucaauauaccaaggaggaauauucgaacuaaaagaaaacgaccgaauauucguaucaguaacaaacgaacaccuaauagacauggaccacgaagcaucauucuucggagcauuccucgucggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 727 - RNA, 784 nt, Artificial Sequence
  mRNA product Design1 comprising derived and/or modified sequence from Homo sapiens__NP_003801.1__HsTNFSF10(95-281) (opt13)
gggagaaagcuuaccaugacaucagaagaaacaauaucaacaguacaagaaaaacaacaaaacauaucaccccuaguaagagaaagaggaccacaacgaguagcagcacacauaacaggaacaagaggacgaucaaacacacuaucaucaccaaacuccaaaaacgaaaaagcacuaggaagaaaaauaaacucaugggaaucaucaagaagcggacacucauuucuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaucuuacccagacccaauacuacuaaugaaaucagcaagaaacagcugcuggucaaaagacgcagaauacggacuauacucaauauaccaagguggaauauucgaacuaaaagaaaacgacagaauauucguaucaguaacaaacgaacacuuaauagacauggaccacgaagcaucauucuucggagcauucuuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 728 - RNA, 835 nt, Artificial Sequence
  mRNA product Design1 comprising derived and/or modified sequence from Homo sapiens__NP_003801.1__HsALB(1-18)_HsTNFSF10(95-281) (opt13)
gggagaaagcuuaccaugaaauggguaacauucauaucacuacuauuccuauucucaucagcauacucaacaucagaagaaacaauaagcacaguacaagaaaaacaacaaaacauaucaccacucguaagagaaagaggaccacaaagaguagcagcacacauaacaggaacaagaggacgaucaaacacacuaucaucaccaaacagcaaaaacgaaaaagcacuaggaagaaaaaucaauucaugggaauccucaagaucaggacacucauuccuauccaaccuacaccuaagaaacggagaauuagucauacacgaaaaaggauucuacuacauauacucacaaacauacuucagauuccaagaagaaauaaaagaaaacaccaaaaacgacaaacaaaugguacaauacauauacaaauacacaucauacccagacccaauacuacuaaugaaaucagcaagaaacaguugcuggucaaaagacgcagaauacggacuauacucaauauaccaaggaggaauauucgaacuaaaagaaaacgacagaauauucguaucaguaacaaacgaacaccuaauagauauggaccacgaagcaucauucuucggagccuuccuaguaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 729 - RNA, 931 nt, Artificial Sequence
  mRNA product Design1 comprising derived and/or modified sequence from Homo sapiens__NP_003801.1__HsALB(1-18)_ILZ_HsTNFSF10(95-281) (opt13)
gggagaaagcuuaccaugaaauggguaacauuuauaucacuauuauuccuauucucaagcgcauacucaagaaugaaacaaauagaagacaaaauagaagaaauacuaucaaaaauauaccacauagaaaacgaaauagcacgaauaaaaaaacuaauaggagaaacaucagaagaaaccauaagcacaguacaagaaaaacaacaaaacauaagcccacuuguaagagaaagaggaccacaaagaguagcagcacacauaacaggaacaagaggaagauccaacacauuaucauccccaaacucaaaaaacgaaaaagcacuaggacgaaaaauaaacagcugggaaucaagcagaucaggacacucauuccuaagcaaccuacaccuaagaaacggagaauuaguaauacacgaaaaaggauucuacuacauauacucccaaacauacuuccgauuccaagaagaaauaaaagaaaacacaaaaaacgacaaacaaaugguacaauacauauacaaauacaccucauacccagacccaauacuacuaaugaaaagcgcaagaaacucaugcuggucaaaagacgcagaauacggacuauacucaauauaccaaggaggaauauucgaauuaaaagaaaacgaucgaauauucguaagcguaacaaacgaacaccuaauagacauggaccaugaagcaucauucuucggagcauuccucguaggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 730 - RNA, 1294 nt, Artificial Sequence
  mRNA product Design1 comprising derived and/or modified sequence from Rattus norvegicus__NP_036656.1__RnCebpa (opt13)
gggagaaagcuuaccauggaaagugcggauuuuuacgaagcagaaccaagaccaccaauguccucucaucuucaaucaccaccucaugcuccaucaaaugcugcauuugguuuuccaagaggagcuggaccagcaccuccaccagcaccucccgcagcaccagaacccuuaggagguauaugcgaacaugaaacaucaauagauauaucagcauacauagauccugcagcauucaaugaugaauuuuuagcagauuuauuucaacauucaagacaacaagaaaaagcuaaagcagcugcaggaccagcagguggaggaggagauuuugacuauccaggugcaccagcaggccccggaggcgcaguaaugagcgccggagcccauggaccaccaccaggauacgguugugcugcagcaggcuauuuagacggaagacuagaaccauuauaugaacgaguaggagcuccagcauuaagaccauuaguaauuaaacaagaaccaagagaagaagaugaagcaaaacaacuagcauuagcaggacuauuuccauaucaaccacccccaccuccaccaccaccacacccacacgcauccccagcacacuuagcagcaccacauuuacaauuucaaauagcacauuguggacaaacaacuaugcauuuacaaccaggacauccaacaccaccaccaacaccuguuccuucaccacacccagcaccagcaaugggagcagcaggauuaccaggaccaggaggaucauuaaaaggauuagcuggaccacauccagaucucagaacaggaggaggaggaggaggaggagcaggagcuggaaaagcaaaaaaaucaguagauaaaaacucaaaugaauauagaguaagaagggaaagaaauaacauagcaguaagaaaaaguagagauaaagcaaaacaaagaaauguagaaacacaacaaaaaguauuagaauuaaccucagauaaugaucgauuaagaaaaagaguagaacaauuaucaagagaauuagauacauuaagagguauuuuuagacaauuaccagaaucuucacuaguaaaagcaaugggaaacugcgcuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 731 - RNA, 1252 nt, Artificial Sequence
  mRNA product Design1 comprising derived and/or modified sequence from Rattus norvegicus__NP_036656.1__RnCebpa(15-344) (opt13)
gggagaaagcuuaccaugucaagccaucuacaaaguccaccacaugcaccaucaaaugccgcauuuggguuuccaagaggagcaggaccagcaccaccaccagcaccaccagccgcuccagaaccauuaggaggaauaugugagcaugaaacaucaauagauauaucagcauauauagauccagcagcauuuaaugaugaauuucuugcagauuuauuucaacauucacgacaacaagaaaaagccaaagcagcagcaggaccagcaggaggaggcggagauuuugauuauccuggagcaccagcaggaccaggaggcgcaguaauguccgcaggagcacacggaccaccaccaggauauggaugugcagcugcaggauauuuagauggacgucuugaaccauuauaugaacgagucggagcuccagcacuaagaccacuaguaauaaaacaagaaccaagagaagaagaugaagcuaaacaacuugcacuagcaggacuauucccauaucaaccaccaccuccaccaccaccaccacacccacaugcaaguccagcccauuuagcagcaccacauuuacaauuucaaauagcccacuguggacaaacaacuaugcauuuacaaccaggacauccuacaccaccaccgacaccuguaccaucaccucauccugcaccagcuaugggagcagcaggauuaccaggaccaggaggaucacuaaaaggauuagcaggaccucauccagaucuaagaacaggagguggagggggaggaggagcaggagcagggaaagcaaaaaaaucaguagauaaaaacucaaaugaauauagaguaagaagagaaagaaauaauauagcaguaagaaaaaguagagauaaagcaaaacaacgaaauguagaaacacaacaaaaaguacuagaauuaacaagcgauaaugacagauuaagaaaaagaguagaacaauuaucaagagaauuagauacacuacgaggaaucuuuagacaacuaccagaaaguaguuuaguuaaagcuaugggaaauugugcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 732 - RNA, 1297 nt, Artificial Sequence
  mRNA product Design1 comprising derived and/or modified sequence from Mus musculus__NP_031704.2 __MmCebpa (opt13)
gggagaaagcuuaccauggaaucagcagauuuuuaugaaguugaaccuagaccaccaaugagcucacaucuacaaucaccaccacacgcaccuucuaacgcugcauuuggauuuccacgaggagcaggccccgcaccuccaccagcaccaccagcugcaccagaaccucuuggaggaauaugcgaacacgaaacaaguauagauaucucagcauauauagacccagcagcauucaaugaugaauuuuuagcagacuuauuucaacauucaagacaacaagaaaaagcaaaagcagcagcaggaccagcaggaggaggaggagacuucgauuauccuggagcucccgcagguccuggcggagcaguaaugucagccggagcacauggaccaccuccaggauauggaugugcagcagcuggauauuuagacggaagguuagaaccacuauaugaaagaguaggagcaccagcauuacgaccacuaguuauaaaacaagaaccuagagaagaagacgaagcaaaacaacuagcacuagcagguuuauuuccauaccaaccuccaccaccucccccaccaccucacccacaugcaucaccagcacacuuagcggcaccacauuuacaauuucaaauagcacauuguggacaaacaacaaugcauuuacaaccuggacauccaacaccaccaccaacaccgguaccaucaccucaugcagcaccagcacucggagcagcaggucuaccaggaccaggaucagcuuuaaaaggauuagcaggagcacauccagauuuaagaacagguggagguggaggaggaaguggugcaggagcaggcaaagcaaaaaaaucagucgauaaaaacuccaacgaauacagaguaagaagagaaagaaacaauauagcagugagaaaaaguagagacaaagcaaaacaacgaaauguagaaacacaacaaaaaguauuagaguuaacaucagauaaugaucgauuaagaaaaagaguugaacaauuaucaagagaacuagauacacuaagaggaauauuuagacaauuaccagaaucaucauuaguaaaagcaaugggaaacugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 733 - RNA, 1255 nt, Artificial Sequence
  mRNA product Design1 comprising derived and/or modified sequence from Mus musculus__NP_031704.2 __MmCebpa(15-359) (opt13)
gggagaaagcuuaccaugagcagucaucuacaaucaccaccacaugcaccuucaaaugcagcauuuggauuuccacgaggagcagguccagcacccccaccagcaccaccagcagcaccugaaccucuagguggaaucugugaacaugaaacaaguauagauaucucagcauauauagauccagcagcauuuaaugaugaauuuuuagcugaucuuuuucaacacucaaggcaacaagaaaaagcaaaagcagcagccggaccagcaggaggaggaggagauuuugauuaucccggagcaccagcaggaccaggcggagcaguaaugucagcuggugcacaugguccgccaccuggauaugggugugcagcagcaggauauuuagauggaagauuagaaccacuauaugaaagagucggugcaccagcauuaagaccccuaguaauaaaacaagaaccaagagaagaagacgaagcaaaacaacuagcauuagcaggccuauuuccauaucaaccaccaccaccaccacccccaccacauccacaugcaucaccagcacaucuagcagcuccacauuuacaauuccaaauagcucauuguggacaaacaacaaugcaucuacaaccuggacacccaacaccaccaccaacuccaguaccaucaccacacgcagcaccagcacuaggagcagcaggccuaccaggaccaggaagugcuuuaaaaggauuagcuggugcacauccagauuuaagaacaggagguggcggaggaggaaguggugcaggagcaggcaaagcaaagaaaagcguagauaaaaauucuaaugaauauagaguaagaagagaaaggaauaauauagcaguacgaaaaucuagagauaaagcaaaacaacgaaauguagaaacacaacaaaaaguucuagaauuaacaucagauaacgauagacuaagaaaaagagucgaacaauuaucaagggaauuagacacauuaagaggcauauucagacaacuuccagaaucaucauuagucaaagcaaugggaaauugugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 734 - RNA, 1294 nt, Artificial Sequence
  mRNA product Design1 comprising derived and/or modified sequence from Homo sapiens__NP_004355.2__HsCEBPA (opt13)
gggagaaagcuuaccauggaaucugcagauuuuuaugaagcagaaccaagaccaccuauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 735 - RNA, 1252 nt, Artificial Sequence
  mRNA product Design1 comprising derived and/or modified sequence from Homo sapiens__NP_004355.2__HsCEBPA(15-358) (opt13)
gggagaaagcuuaccauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 736 - RNA, 1642 nt, Artificial Sequence
  mRNA product Design1 comprising derived and/or modified sequence from Homo sapiens__NP_000448.3__HsHNF4A (opt13)
gggagaaagcuuaccaugagacuaaguaaaacauuaguagacauggacauggccgacuauagugccgcauuagauccagcuuauacaacacuagaauuugaaaacguccaaguauuaacaaugggaaaugacacaucaccaagugaaggcaccaaucuaaaugcaccaaacucacuagguguaucagcccucugcgcaauaugcggagacagagcaacagggaaacacuacggagcaucuucaugugacggauguaaaggcuucuuuagaagaucaguaagaaaaaaccacauguacaguugcagauucagcagacaauguguagucgacaaagauaaaagaaaucaaugcagauauugcagacuaaaaaaauguuuccgagcaggaaugaaaaaagaagcaguacaaaacgaaagagaucguaucucaacaagaagaucaucauacgaagacucaagucuaccaagcauaaacgcacuucuucaagcagaaguacuaagcagacaaauaacaagcccgguaucagguaucaacggagacauaagggcaaaaaaaauagcgucaauagcagacguaugcgaaaguaugaaagaacaauuacuuguccuuguagaaugggcaaaauacauaccugcauuuugcgaauuaccacuagacgaccaaguagcacuauuaagagcacaugcaggagaacaccuucuacuaggagcuacuaaaagaucaaugguauuuaaagacguacuauuacuaggaaaugauuacauaguaccaagacacugcccagaacuugcagaaaugucacgaguaagcauaagaauccuagaugaacuugucuuaccauuccaagaauuacaaauagacgacaacgaauacgcauaucuaaaagcaauaauauuuuucgacccagacgcaaaaggacuaucagauccaggcaaaauuaaacgacuccgaucacaaguucaaguaucucuagaagacuauauaaacgaucgacaauacgauagucgaggacgauucggugaauuauuacuucuuuuaccaacauuacaaucaauaacguggcaaaugauugaacaaauccaauucauaaaauuauucggaauggcaaaaauagacaaucuauuacaagaaaugcuacuuggaggaagcccaucagacgcuccacacgcccaccacccucuacauccacaccuaaugcaagaacacaugggcacuaacguaauaguagcaaacacaaugcccacccaucuaucaaacggacaaaugugcgaauggccaagacccagaggacaagcugcaacaccagaaacaccacaaccaaguccaccaggagguaguggaagugaaccauacaaacuuuuaccaggagcaguagcaacaauaguaaaaccacuaucagcaauuccccaaccaacaauaacaaaacaagaaguaauauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 737 - RNA, 847 nt, Artificial Sequence
  mRNA product Design1 comprising derived and/or modified sequence from Homo sapiens__NP_061986.1__HsFGF21 (opt13)
gggagaaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 738 - RNA, 1573 nt, Artificial Sequence
  mRNA product Design1 comprising derived and/or modified sequence from Homo sapiens__NP_078852.3__HsOGFRL1 (opt13)
gggagaaagcuuaccaugggaaaccuacucggcggaguuucauucagagaaccaacaacaguagaagacugcgauaguacauggcagaccgauucagaaccugaaccagaagaaccaggccccgguggaggaagcgaaggcccuggacaagaaucagaacaaccagcacaaccaccagaacaagcaggaggaagaccaggagcaagcccagcaccagacgaagacgcagaagcagcaggagccgaacaaggaggagauagcacugaagcaacagcaaaaccaaaaagaucuuuuuacgcagcacgagacuuauauaaauauagacaccaauacccaaauuucaaagacauaagauaccaaaaugaccuauccaaccuacgcuucuacaaaaauaaaauuccauucaaaccagauggaguauacauagaagaaguacuaagcaaauggaaaggugacuaugaaaaacuagaacauaaccacaccuacauacaauggcuauuuccccuaagagaacaaggauuaaauuucuacgcaaaagaacuuacaaccuacgaaauagaagaauuuaaaaaaaccaaagaagccauaagaagauucuuauuagcauacaagaugauguuagaauuuuucggaauuaaacucacagacaaaacaggcaacguagcacgagccguaaacuggcaagaacgauuccaacacuuaaacgaaagucagcacaacuaccuaagaauaacaagaauauuaaaaaguuuaggagaacuaggcuacgaaucauucaaaucuccacuuguaaaauucauacuacacgaagccuuagucgaaaacacaauaccaaacauaaaacaaucugcacuagaauacuuuguauacacaauaagagacagaagagaaaggagaaaauuacuacgauucgcucaaaaacacuauacaccaucagaaaauuucauauggggccccccaagaaaagaacaaagcgaaggcucaaaagcacaaaaaaugucaaguccacuagcaucaagccauaacucacaaacuucaaugcacaaaaaagccaaagacucaaagaacucaucaucagccguacaccuaaacagcaaaacagcagaagauaaaaaaguugcaccaaaagaaccaguagaagaaacagauagaccaucaccagaaccaucaaacgaagcggcaaaaccaagaaacacugagaaagauagcaacgcagaaaacaugaacagccaaccagaaaaaacaguaacgacaccaacugaaaaaaaagaaucaguaaguccagaaaauaaugaagaaggcggcaacgauaaccaagacaacgaaaauccaggaaauaccaacugccacgacguaguauuaguacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 739 - RNA, 775 nt, Artificial Sequence
  mRNA product Design1 comprising derived and/or modified sequence from Homo sapiens__NP_008842.1__HsRLN1 (opt13)
gggagaaagcuuaccaugccaagacuauucuuauuccaccuacuagaauuuugcuuacuacuaaaccaauucucaagagcaguagcagcaaaauggaaagacgacguaauaaaacuaugcggaagagaacuuguaagagcacaaauagcaauaugcggaaugucaacauggucaaaaagaucacuaucacaagaagacgccccacaaacaccaagaccaguagcagaaauaguaccaucauucauaaacaaagacacagaaacaauaauaauaaugcuagaauuuauagcaaaccuaccaccagaauuaaaagcagcauuaucagaaagacaaccaucauuaccagaacuacaacaauacguaccagcacuaaaagacucaaaccuaucauucgaagaauuuaaaaaacuaauaagaaacagacaaucagaagcagcagacucaaacccaucagaacuaaaauaccuaggacuagacacacacucacaaaaaaaacgaagaccauacguagcacuauuugaaaaaugcugcuuaauaggaugcacaaaaagaucacuagcaaaauacugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 740 - RNA, 775 nt, Artificial Sequence
  mRNA product Design1 comprising derived and/or modified sequence from Homo sapiens__NP_604390.1__HsRLN2 (opt13)
gggagaaagcuuaccaugccaagacuauucuuuuuccaccuacuaggcguaugccuccuacuaaaccaauuuucaagagcaguagcagacucauggauggaagaaguaauaaaacuaugcggaagagaacuuguaagagcacaaauagcaauaugcggaaugucaacauggucaaaaagaucauuaucacaagaagacgcaccacaaacaccaagaccaguagcagaaauaguaccaucauucauaaacaaagacacagaaacaaucaauaugaugucagaauuuguagcaaaccucccacaagaacuaaaacuaacacuaucagaaaugcaaccagcacuaccacaauuacaacaacacgucccaguacucaaagacucaucacuauuauucgaagaauuuaaaaaauuaauaagaaacagacaaucagaagcagcagacagcucacccucagaacuaaaauaccuaggacuagacacacacucaagaaaaaaaagacaacuauacucagcacuagccaacaaaugcugccacguaggaugcacaaaaagaucacuagcaagauucugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 741 - RNA, 646 nt, Artificial Sequence
  mRNA product Design1 comprising derived and/or modified sequence from Homo sapiens__NP_543140.1__HsRLN3  (opt13)
gggagaaagcuuaccauggcaagauauauguuauuauuauuauuagcaguauggguauuaacaggagaauuauggccaggagcagaagcaagagcagcaccauauggaguaagauuauguggaagagaauuuauaagagcaguaauauuuacauguggaggaaguagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaagcauuuuauagaggaagaccaaguuggcaaggaacaccaggaguauuaagaggaaguagagauguauuagcaggauuaaguucaaguuguuguaaauggggauguucaaaaucagaaauaaguucauuauguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 742 - RNA, 1627 nt, Artificial Sequence
  mRNA product Design1 comprising derived and/or modified sequence from Homo sapiens__NP_002412.1__HsMMP1 (opt13)
gggagaaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 743 - RNA, 1387 nt, Artificial Sequence
  mRNA product Design1 comprising derived and/or modified sequence from Homo sapiens__NP_002412.1__HsMMP1(1-19,100-469) (opt13)
gggagaaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 744 - RNA, 3574 nt, Artificial Sequence
  mRNA product Design1 comprising derived and/or modified sequence from Clostridium histolyticum__BAA77453.1__ColG (opt13)
gggagaaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 745 - RNA, 3298 nt, Artificial Sequence
  mRNA product Design1 comprising derived and/or modified sequence from Clostridium histolyticum__BAA77453.1__HsALB(1-18)_ColG(111-1118) (opt13)
gggagaaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 746 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt13)
gggagaaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 747 - RNA, 3322 nt, Artificial Sequence
  mRNA product Design1 comprising derived and/or modified sequence from Clostridium histolyticum__BAA34542.1__ColH (opt13)
gggagaaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 748 - RNA, 3283 nt, Artificial Sequence
  mRNA product Design1 comprising derived and/or modified sequence from Clostridium histolyticum__BAA34542.1__ColH (opt13)
gggagaaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 749 - RNA, 3217 nt, Artificial Sequence
  mRNA product Design1 comprising derived and/or modified sequence from Clostridium histolyticum__BAA34542.1__HsALB(1-18)_ColH(41-1021) (opt13)
gggagaaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 750 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt13)
gggagaaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 751 - RNA, 1228 nt, Artificial Sequence
  mRNA product Design2 comprising derived and/or modified sequence from Homo sapiens__NP_003801.1__HsTNFSF10  (wt)
ggggcgcugccuacggagguggcagccaucuccuucucggcaucaagcuuaccauggcuaugauggagguccaggggggacccagccugggacagaccugcgugcugaucgugaucuucacagugcuccugcagucucucuguguggcuguaacuuacguguacuuuaccaacgagcugaagcagaugcaggacaaguacuccaaaaguggcauugcuuguuucuuaaaagaagaugacaguuauugggaccccaaugacgaagagaguaugaacagccccugcuggcaagucaaguggcaacuccgucagcucguuagaaagaugauuuugagaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 752 - RNA, 949 nt, Artificial Sequence
  mRNA product Design2 comprising derived and/or modified sequence from Homo sapiens__NP_003801.1__HsTNFSF10(95-281) (wt)
ggggcgcugccuacggagguggcagccaucuccuucucggcaucaagcuuaccaugaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 753 - RNA, 1000 nt, Artificial Sequence
  mRNA product Design2 comprising derived and/or modified sequence from Homo sapiens__NP_003801.1__HsALB(1-18)_HsTNFSF10(95-281) (wt)
ggggcgcugccuacggagguggcagccaucuccuucucggcaucaagcuuaccaugaaguggguaaccuuuauuucccuucuuuuucucuuuagcucggcuuauuccaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 754 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (wt)
ggggcgcugccuacggagguggcagccaucuccuucucggcaucaagcuuaccaugaaguggguaaccuuuauuucccuucuuuuucucuuuagcucggcuuauuccagaaugaagcagaucgaggacaaaauugaagagauccugagcaagauuuaccacaucgaaaacgagauugccaggaucaaaaagcucauuggcgaaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 755 - RNA, 1459 nt, Artificial Sequence
  mRNA product Design2 comprising derived and/or modified sequence from Rattus norvegicus__NP_036656.1__RnCebpa (wt)
ggggcgcugccuacggagguggcagccaucuccuucucggcaucaagcuuaccauggagucggccgacuucuacgaggcggagccgcggcccccgaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 756 - RNA, 1417 nt, Artificial Sequence
  mRNA product Design2 comprising derived and/or modified sequence from Rattus norvegicus__NP_036656.1__RnCebpa(15-344) (wt)
ggggcgcugccuacggagguggcagccaucuccuucucggcaucaagcuuaccaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 757 - RNA, 1462 nt, Artificial Sequence
  mRNA product Design2 comprising derived and/or modified sequence from Mus musculus__NP_031704.2 __MmCebpa (wt)
ggggcgcugccuacggagguggcagccaucuccuucucggcaucaagcuuaccauggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 758 - RNA, 1420 nt, Artificial Sequence
  mRNA product Design2 comprising derived and/or modified sequence from Mus musculus__NP_031704.2 __MmCebpa(15-359) (wt)
ggggcgcugccuacggagguggcagccaucuccuucucggcaucaagcuuaccaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 759 - RNA, 1459 nt, Artificial Sequence
  mRNA product Design2 comprising derived and/or modified sequence from Homo sapiens__NP_004355.2__HsCEBPA (wt)
ggggcgcugccuacggagguggcagccaucuccuucucggcaucaagcuuaccauggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 760 - RNA, 1417 nt, Artificial Sequence
  mRNA product Design2 comprising derived and/or modified sequence from Homo sapiens__NP_004355.2__HsCEBPA (wt)
ggggcgcugccuacggagguggcagccaucuccuucucggcaucaagcuuaccaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 761 - RNA, 1459 nt, Artificial Sequence
  mRNA product Design2 comprising derived and/or modified sequence from Homo sapiens__NP_004355.2__HsCEBPA(15-358) (wt)
ggggcgcugccuacggagguggcagccaucuccuucucggcaucaagcuuaccauggagucggccgacuucuacgaggcggagccgcggcccccgaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 762 - RNA, 1417 nt, Artificial Sequence
  mRNA product Design2 comprising derived and/or modified sequence from Homo sapiens__NP_004355.2__HsCEBPA(15-358) (wt)
ggggcgcugccuacggagguggcagccaucuccuucucggcaucaagcuuaccaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 763 - RNA, 1807 nt, Artificial Sequence
  mRNA product Design2 comprising derived and/or modified sequence from Homo sapiens__NP_000448.3__HsHNF4A (wt)
ggggcgcugccuacggagguggcagccaucuccuucucggcaucaagcuuaccaugcgacucuccaaaacccucgucgacauggacauggccgacuacagugcugcacuggacccagccuacaccacccuggaauuugagaaugugcagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccugcugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 764 - RNA, 1807 nt, Artificial Sequence
  mRNA product Design2 comprising derived and/or modified sequence from Homo sapiens__NP_000448.3__HsHNF4A (wt)
ggggcgcugccuacggagguggcagccaucuccuucucggcaucaagcuuaccaugcgacucuccaaaacccucgucgacauggacauggccgacuacagugcugcacuggacccagccuacaccacccuggaauuugagaauguccagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccuccugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccagguccaggugagcuuggaggacuacaucaacgaccgccaguaugacucgcguggccgcuuuggagagcugcugcugcugcugcccaccuugcagagcaucaccuggcagaugaucgagcagauccaguucaucaagcuguucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 765 - RNA, 1012 nt, Artificial Sequence
  mRNA product Design2 comprising derived and/or modified sequence from Homo sapiens__NP_061986.1__HsFGF21 (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 766 - RNA, 1012 nt, Artificial Sequence
  mRNA product Design2 comprising derived and/or modified sequence from Homo sapiens__NP_061986.1__HsFGF21 (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 767 - RNA, 1738 nt, Artificial Sequence
  mRNA product Design2 comprising derived and/or modified sequence from Homo sapiens__NP_078852.3__HsOGFRL1 (wt)
ggggcgcugccuacggagguggcagccaucuccuucucggcaucaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaauucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaauucucaaccugagaaaacaguuacuacucccacagaaaaaaaggagaguguaucuccugagaauaacgaagaagguggaaaugauaaccaagacaaugaaaauccuggaaauacaaauugccaugauguuguacuaguacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 768 - RNA, 1738 nt, Artificial Sequence
  mRNA product Design2 comprising derived and/or modified sequence from Homo sapiens__NP_078852.3__HsOGFRL1 (wt)
ggggcgcugccuacggagguggcagccaucuccuucucggcaucaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaguucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaacucucaaccugagaaaacaguuacuacucccacagaaaaaaaggagaguguaucuccugagaauaacgaagaagguggaaaugauaaccaagacaaugaaaauccuggaaauacaaauugccaugauguuguacuuguacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 769 - RNA, 940 nt, Artificial Sequence
  mRNA product Design2 comprising derived and/or modified sequence from Homo sapiens__NP_008842.1__HsRLN1 (wt)
ggggcgcugccuacggagguggcagccaucuccuucucggcaucaagcuuaccaugccucgccuguucuuguuccaccugcuagaauucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaauucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 770 - RNA, 940 nt, Artificial Sequence
  mRNA product Design2 comprising derived and/or modified sequence from Homo sapiens__NP_008842.1__HsRLN1 (wt)
ggggcgcugccuacggagguggcagccaucuccuucucggcaucaagcuuaccaugccucgccuguucuuguuccaccuccuagaguucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaguucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 771 - RNA, 940 nt, Artificial Sequence
  mRNA product Design2 comprising derived and/or modified sequence from Homo sapiens__NP_604390.1__HsRLN2 (wt)
ggggcgcugccuacggagguggcagccaucuccuucucggcaucaagcuuaccaugccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 772 - RNA, 811 nt, Artificial Sequence
  mRNA product Design2 comprising derived and/or modified sequence from Homo sapiens__NP_543140.1__HsRLN3  (wt)
ggggcgcugccuacggagguggcagccaucuccuucucggcaucaagcuuaccauggccagguacaugcugcugcugcuccuggcgguaugggugcugaccggggagcuguggccgggagcugaggcccgggcagcgccuuacggggucaggcuuugcggccgagaauucauccgagcagucaucuucaccugcgggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 773 - RNA, 811 nt, Artificial Sequence
  mRNA product Design2 comprising derived and/or modified sequence from Homo sapiens__NP_543140.1__HsRLN3  (wt)
ggggcgcugccuacggagguggcagccaucuccuucucggcaucaagcuuaccauggccagguacaugcugcugcugcuccuggcgguaugggugcugaccggggagcuguggccgggagcugaggcccgggcagcgccuuacggggucaggcuuugcggccgagaguucauccgagcagucaucuucaccugugggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 774 - RNA, 1792 nt, Artificial Sequence
  mRNA product Design2 comprising derived and/or modified sequence from Homo sapiens__NP_002412.1__HsMMP1 (wt)
ggggcgcugccuacggagguggcagccaucuccuucucggcaucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 775 - RNA, 1792 nt, Artificial Sequence
  mRNA product Design2 comprising derived and/or modified sequence from Homo sapiens__NP_002412.1__HsMMP1 (wt)
ggggcgcugccuacggagguggcagccaucuccuucucggcaucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 776 - RNA, 1552 nt, Artificial Sequence
  mRNA product Design2 comprising derived and/or modified sequence from Homo sapiens__NP_002412.1__HsMMP1(1-19,100-469) (wt)
ggggcgcugccuacggagguggcagccaucuccuucucggcaucaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 777 - RNA, 3739 nt, Artificial Sequence
  mRNA product Design2 comprising derived and/or modified sequence from Clostridium histolyticum__BAA77453.1__ColG (wt)
ggggcgcugccuacggagguggcagccaucuccuucucggcaucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 778 - RNA, 3739 nt, Artificial Sequence
  mRNA product Design2 comprising derived and/or modified sequence from Clostridium histolyticum__BAA77453.1__ColG (wt)
ggggcgcugccuacggagguggcagccaucuccuucucggcaucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 779 - RNA, 3463 nt, Artificial Sequence
  mRNA product Design2 comprising derived and/or modified sequence from Clostridium histolyticum__BAA77453.1__HsALB(1-18)_ColG(111-1118) (wt)
ggggcgcugccuacggagguggcagccaucuccuucucggcaucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 780 - RNA, 3463 nt, Artificial Sequence
  mRNA product Design2 comprising derived and/or modified sequence from Clostridium histolyticum__BAA77453.1__HsALB(1-18)_ColG(111-1118) (wt)
ggggcgcugccuacggagguggcagccaucuccuucucggcaucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 781 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (wt)
ggggcgcugccuacggagguggcagccaucuccuucucggcaucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 782 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (wt)
ggggcgcugccuacggagguggcagccaucuccuucucggcaucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 783 - RNA, 3487 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 784 - RNA, 3487 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 785 - RNA, 3448 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 786 - RNA, 3448 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 787 - RNA, 3382 nt, Artificial Sequence
  mRNA product Design2 comprising derived and/or modified sequence from Clostridium histolyticum__BAA34542.1__HsALB(1-18)_ColH(41-1021) (wt)
ggggcgcugccuacggagguggcagccaucuccuucucggcaucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 788 - RNA, 3382 nt, Artificial Sequence
  mRNA product Design2 comprising derived and/or modified sequence from Clostridium histolyticum__BAA34542.1__HsALB(1-18)_ColH(41-1021) (wt)
ggggcgcugccuacggagguggcagccaucuccuucucggcaucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 789 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (wt)
ggggcgcugccuacggagguggcagccaucuccuucucggcaucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 790 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (wt)
ggggcgcugccuacggagguggcagccaucuccuucucggcaucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 791 - RNA, 1228 nt, Artificial Sequence
  mRNA product Design2 comprising derived and/or modified sequence from Homo sapiens__NP_003801.1__HsTNFSF10 (opt1)
ggggcgcugccuacggagguggcagccaucuccuucucggcaucaagcuuaccauggccaugauggaggugcagggcgggcccagccugggccagaccugcguccucaucgugaucuucaccgugcugcugcagucccucugcgucgccgugacguacguguacuucaccaacgagcugaagcagaugcaggacaaguacagcaaguccgggaucgcgugcuuccugaaggaggacgacagcuacugggacccgaacgacgaggaguccaugaacagcccgugcuggcaggucaaguggcagcuccgccagcuggugcggaagaugauccugcgcaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 792 - RNA, 949 nt, Artificial Sequence
  mRNA product Design2 comprising derived and/or modified sequence from Homo sapiens__NP_003801.1__HsTNFSF10(95-281) (opt1)
ggggcgcugccuacggagguggcagccaucuccuucucggcaucaagcuuaccaugaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 793 - RNA, 1000 nt, Artificial Sequence
  mRNA product Design2 comprising derived and/or modified sequence from Homo sapiens__NP_003801.1__HsALB(1-18)_HsTNFSF10(95-281) (opt1)
ggggcgcugccuacggagguggcagccaucuccuucucggcaucaagcuuaccaugaagugggugaccuucaucagccugcucuuccuguucuccagcgccuacuccaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 794 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt1)
ggggcgcugccuacggagguggcagccaucuccuucucggcaucaagcuuaccaugaagugggugaccuucaucagccugcucuuccuguucuccagcgccuacucccgcaugaagcagaucgaggacaagaucgaggagauccugagcaagaucuaccacaucgagaacgagaucgcccggaucaagaagcucaucggcgagaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 795 - RNA, 1459 nt, Artificial Sequence
  mRNA product Design2 comprising derived and/or modified sequence from Rattus norvegicus__NP_036656.1__RnCebpa (opt1)
ggggcgcugccuacggagguggcagccaucuccuucucggcaucaagcuuaccauggagagcgccgacuucuacgaggccgagccccgcccgcccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 796 - RNA, 1417 nt, Artificial Sequence
  mRNA product Design2 comprising derived and/or modified sequence from Rattus norvegicus__NP_036656.1__RnCebpa(15-344) (opt1)
ggggcgcugccuacggagguggcagccaucuccuucucggcaucaagcuuaccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 797 - RNA, 1462 nt, Artificial Sequence
  mRNA product Design2 comprising derived and/or modified sequence from Mus musculus__NP_031704.2 __MmCebpa (opt1)
ggggcgcugccuacggagguggcagccaucuccuucucggcaucaagcuuaccauggagagcgccgacuucuacgagguggagccccgcccgcccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 798 - RNA, 1420 nt, Artificial Sequence
  mRNA product Design2 comprising derived and/or modified sequence from Mus musculus__NP_031704.2 __MmCebpa(15-359) (opt1)
ggggcgcugccuacggagguggcagccaucuccuucucggcaucaagcuuaccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 799 - RNA, 1459 nt, Artificial Sequence
  mRNA product Design2 comprising derived and/or modified sequence from Homo sapiens__NP_004355.2__HsCEBPA (opt1)
ggggcgcugccuacggagguggcagccaucuccuucucggcaucaagcuuaccauggagagcgccgacuucuacgaggccgagccccgcccgcccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 800 - RNA, 1417 nt, Artificial Sequence
  mRNA product Design2 comprising derived and/or modified sequence from Homo sapiens__NP_004355.2__HsCEBPA(15-358) (opt1)
ggggcgcugccuacggagguggcagccaucuccuucucggcaucaagcuuaccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 801 - RNA, 1807 nt, Artificial Sequence
  mRNA product Design2 comprising derived and/or modified sequence from Homo sapiens__NP_000448.3__HsHNF4A (opt1)
ggggcgcugccuacggagguggcagccaucuccuucucggcaucaagcuuaccaugcgccugagcaagacccucguggacauggacauggccgacuacuccgccgcgcuggaccccgccuacaccacgcuggaguucgagaacguccaggugcucaccaugggcaacgacaccagcccguccgaggggaccaaccugaacgcccccaacagccugggcguguccgcccucugcgccaucugcggggaccgggcgacgggcaagcacuacggggccagcuccugcgacggcugcaagggcuucuuccgccggagcguccgcaagaaccacauguacuccugccgguucagccgccagugcgugguggacaaggacaagcggaaccagugccgcuacugccggcugaagaagugcuuccgcgccgggaugaagaaggaggccguccagaacgagcgggaccgcaucuccacccggcgcagcuccuacgaggacagcucccugcccagcaucaacgcgcuccugcaggccgaggugcugucccggcagaucaccagccccguguccggcaucaacggggacauccgcgccaagaagaucgccagcaucgccgacgucugcgagagcaugaaggagcagcuccuggugcugguggagugggcgaaguacaucccggccuucugcgagcucccccuggacgaccaggucgcccugcuccgggcccacgccggcgagcaccuccugcugggggcgaccaagcgcuccaugguguucaaggacgugcugcugcucggcaacgacuacaucgucccccggcacugccccgagcuggccgagaugagccgcguguccauccggauccuggacgagcucgugcugccguuccaggagcugcagaucgacgacaacgaguacgccuaccucaaggccaucaucuucuucgaccccgacgccaagggccugagcgaccccgggaagaucaagcgccugcgcucccagguccaggugagccucgaggacuacaucaacgaccggcaguacgacucccgcggccgguucggggagcugcugcuccugcugcccacgcuccagagcaucaccuggcagaugaucgagcagauccaguucaucaagcuguucggcauggcgaagaucgacaaccugcuccaggagaugcugcugggcggguccccgagcgacgcgccccacgcccaccacccccuccacccccaccugaugcaggagcacaugggcaccaacgugaucgucgccaacaccaugccgacgcaccuguccaacgggcagaugugcgaguggccccgcccccggggccaggccgccacccccgagaccccgcagcccagcccgcccgggggcuccggcagcgagcccuacaagcuccugcccggggccguggccaccaucgugaagccccuguccgccaucccccagccgacgaucaccaagcaggaggucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 802 - RNA, 1012 nt, Artificial Sequence
  mRNA product Design2 comprising derived and/or modified sequence from Homo sapiens__NP_061986.1__HsFGF21 (opt1)
ggggcgcugccuacggagguggcagccaucuccuucucggcaucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 803 - RNA, 1738 nt, Artificial Sequence
  mRNA product Design2 comprising derived and/or modified sequence from Homo sapiens__NP_078852.3__HsOGFRL1 (opt1)
ggggcgcugccuacggagguggcagccaucuccuucucggcaucaagcuuaccaugggcaaccugcucgggggcgugagcuuccgcgagcccaccaccgucgaggacugcgacuccacguggcagaccgacagcgagccggagcccgaggagcccgggcccggcgggggcuccgagggcccggggcaggagagcgagcagcccgcccagccgcccgagcaggccggcgggcggcccggcgcgucccccgcccccgacgaggacgccgaggccgccggggcggagcagggcggcgacagcaccgaggccaccgccaagcccaagcgcuccuucuacgccgcgcgggaccuguacaaguaccgccaccaguacccgaacuucaaggacauccgguaccagaacgaccugagcaaccuccgcuucuacaagaacaagauccccuucaagcccgacgggguguacaucgaggaggugcuguccaaguggaagggcgacuacgagaagcuggagcacaaccacacguacauccaguggcuguucccccuccgggagcaggggcugaacuucuacgccaaggagcucaccaccuacgagaucgaggaguucaagaagaccaaggaggccauccgccgguuccugcuggccuacaagaugaugcucgaguucuucggcaucaagcugacggacaagaccggcaacgucgcccgcgcggugaacuggcaggagcgguuccagcaccugaacgagagccagcacaacuaccuccgcaucacccggauccugaagucccugggggagcucggcuacgagagcuucaaguccccgcuggugaaguucauccugcacgaggcccucgucgagaacaccauccccaacaucaagcagagcgcccuggaguacuucguguacacgauccgcgaccggcgcgagcggcgcaagcugcuccgguucgcccagaagcacuacacccccuccgagaacuucaucugggggcccccgcgcaaggagcagagcgagggcuccaaggcccagaagaugagcagcccccuggcguccagccacaacucccagaccagcaugcacaagaaggccaaggacuccaagaacagcuccagcgccgugcaccugaacuccaagaccgccgaggacaagaaggucgcccccaaggagcccguggaggagacggaccggccgagccccgagcccuccaacgaggcggccaagccccgcaacaccgagaaggacagcaacgccgagaacaugaacucccagccggagaagaccgugaccacgcccaccgagaagaaggagagcgucucccccgagaacaacgaggagggcgggaacgacaaccaggacaacgagaacccgggcaacaccaacugccacgacguggugcucguccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 804 - RNA, 940 nt, Artificial Sequence
  mRNA product Design2 comprising derived and/or modified sequence from Homo sapiens__NP_008842.1__HsRLN1 (opt1)
ggggcgcugccuacggagguggcagccaucuccuucucggcaucaagcuuaccaugccccgccuguuccucuuccaccuccuggaguucugccugcugcugaaccaguucagccgggccguggccgcgaaguggaaggacgacgucaucaagcucugcggccgcgagcuggugcgggcccagaucgccaucugcgggauguccaccuggagcaagcgcucccugagccaggaggacgccccgcagacgccccggcccguggccgagaucguccccuccuucaucaacaaggacaccgagaccaucaucaucaugcucgaguucaucgcgaaccugccgcccgagcugaaggccgcccucagcgagcgccagcccucccugcccgagcugcagcaguacgugccggcccucaaggacagcaaccuguccuucgaggaguucaagaagcugauccggaaccgccagagcgaggcggccgacuccaaccccagcgagcucaaguaccugggccuggacacccacucccagaagaagcggcgccccuacguggcccucuucgagaagugcugccugaucgggugcaccaagcggagccuggccaaguacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 805 - RNA, 940 nt, Artificial Sequence
  mRNA product Design2 comprising derived and/or modified sequence from Homo sapiens__NP_604390.1__HsRLN2 (opt1)
ggggcgcugccuacggagguggcagccaucuccuucucggcaucaagcuuaccaugccccgccuguucuucuuccaccuccugggcgugugccugcuccugaaccaguucagccgggccgucgccgacuccuggauggaggaggugaucaagcugugcgggcgcgagcucgugcgggcgcagaucgccaucugcggcaugagcaccugguccaagcgcagccugucccaggaggacgccccgcagacgccccggcccgucgccgagaucgugcccagcuucaucaacaaggacaccgagaccaucaacaugauguccgaguucguggccaaccugccgcaggagcucaagcugacccugagcgagaugcagcccgcgcucccccagcugcagcagcacguccccgugcugaaggacuccagccuccuguucgaggaguucaagaagcugauccgcaaccggcaguccgaggccgccgacagcuccccgagcgagcucaaguaccuggggcuggacacccacucccgcaagaagcggcagcucuacagcgcccuggcgaacaagugcugccacgugggcugcacgaagcgcucccuggcccgguucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 806 - RNA, 811 nt, Artificial Sequence
  mRNA product Design2 comprising derived and/or modified sequence from Homo sapiens__NP_543140.1__HsRLN3  (opt1)
ggggcgcugccuacggagguggcagccaucuccuucucggcaucaagcuuaccauggcccgcuacaugcugcuccugcugcucgccguguggguccugaccggcgagcuguggcccggggcggaggcccgggccgccccguacggcgugcgccucugcgggcgggaguucauccgcgccgugaucuucacgugcggcgggagccgguggcgccgguccgacauccuggcgcacgaggccaugggcgacaccuuccccgacgccgacgccgacgaggacagccuggcgggcgagcucgacgaggccaugggguccagcgaguggcuggcccugaccaagagcccccaggccuucuaccgcggccggcccuccuggcaggggaccccgggcguccuccgcgggucccgggacgugcuggccggccugagcuccagcugcugcaaguggggcugcuccaagagcgagaucuccagccucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 807 - RNA, 1792 nt, Artificial Sequence
  mRNA product Design2 comprising derived and/or modified sequence from Homo sapiens__NP_002412.1__HsMMP1 (opt1) R4749
ggggcgcugccuacggagguggcagccaucuccuucucggcaucaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 808 - RNA, 1552 nt, Artificial Sequence
  mRNA product Design2 comprising derived and/or modified sequence from Homo sapiens__NP_002412.1__HsMMP1(1-19,100-469) (opt1) R4751
ggggcgcugccuacggagguggcagccaucuccuucucggcaucaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 809 - RNA, 3739 nt, Artificial Sequence
  mRNA product Design2 comprising derived and/or modified sequence from Clostridium histolyticum__BAA77453.1__ColG (opt1) R4537
ggggcgcugccuacggagguggcagccaucuccuucucggcaucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 810 - RNA, 3463 nt, Artificial Sequence
  mRNA product Design2 comprising derived and/or modified sequence from Clostridium histolyticum__BAA77453.1__HsALB(1-18)_ColG(111-1118) (opt1) R4791
ggggcgcugccuacggagguggcagccaucuccuucucggcaucaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 811 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt1) R4793
ggggcgcugccuacggagguggcagccaucuccuucucggcaucaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 812 - RNA, 3487 nt, Artificial Sequence
  mRNA product Design2 comprising derived and/or modified sequence from Clostridium histolyticum__BAA34542.1__ColH (opt1)
ggggcgcugccuacggagguggcagccaucuccuucucggcaucaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 813 - RNA, 3448 nt, Artificial Sequence
  mRNA product Design2 comprising derived and/or modified sequence from Clostridium histolyticum__BAA34542.1__ColH (opt1) R4538
ggggcgcugccuacggagguggcagccaucuccuucucggcaucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 814 - RNA, 3382 nt, Artificial Sequence
  mRNA product Design2 comprising derived and/or modified sequence from Clostridium histolyticum__BAA34542.1__HsALB(1-18)_ColH(41-1021) (opt1) R4790
ggggcgcugccuacggagguggcagccaucuccuucucggcaucaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 815 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt1) R4792
ggggcgcugccuacggagguggcagccaucuccuucucggcaucaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 816 - RNA, 1228 nt, Artificial Sequence
  mRNA product Design2 comprising derived and/or modified sequence from Homo sapiens__NP_003801.1__HsTNFSF10 (opt2)
ggggcgcugccuacggagguggcagccaucuccuucucggcaucaagcuuaccauggccaugauggagguccagggcggccccucccucggccagaccugcguccucaucgucaucuucaccguccuccuccagucccucugcgucgccgucaccuacgucuacuucaccaacgagcucaagcagaugcaggacaaguacuccaaguccggcaucgccugcuuccucaaggaggacgacuccuacugggaccccaacgacgaggaguccaugaacucccccugcuggcaggucaaguggcagcuccgccagcucguccgcaagaugauccuccgcaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 817 - RNA, 949 nt, Artificial Sequence
  mRNA product Design2 comprising derived and/or modified sequence from Homo sapiens__NP_003801.1__HsTNFSF10(95-281) (opt2)
ggggcgcugccuacggagguggcagccaucuccuucucggcaucaagcuuaccaugaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 818 - RNA, 1000 nt, Artificial Sequence
  mRNA product Design2 comprising derived and/or modified sequence from Homo sapiens__NP_003801.1__HsALB(1-18)_HsTNFSF10(95-281) (opt2)
ggggcgcugccuacggagguggcagccaucuccuucucggcaucaagcuuaccaugaagugggucaccuucaucucccuccucuuccucuucuccuccgccuacuccaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 819 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt2)
ggggcgcugccuacggagguggcagccaucuccuucucggcaucaagcuuaccaugaagugggucaccuucaucucccuccucuuccucuucuccuccgccuacucccgcaugaagcagaucgaggacaagaucgaggagauccucuccaagaucuaccacaucgagaacgagaucgcccgcaucaagaagcucaucggcgagaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 820 - RNA, 1459 nt, Artificial Sequence
  mRNA product Design2 comprising derived and/or modified sequence from Rattus norvegicus__NP_036656.1__RnCebpa (opt2)
ggggcgcugccuacggagguggcagccaucuccuucucggcaucaagcuuaccauggaguccgccgacuucuacgaggccgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 821 - RNA, 1417 nt, Artificial Sequence
  mRNA product Design2 comprising derived and/or modified sequence from Rattus norvegicus__NP_036656.1__RnCebpa(15-344) (opt2)
ggggcgcugccuacggagguggcagccaucuccuucucggcaucaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 822 - RNA, 1462 nt, Artificial Sequence
  mRNA product Design2 comprising derived and/or modified sequence from Mus musculus__NP_031704.2 __MmCebpa (opt2)
ggggcgcugccuacggagguggcagccaucuccuucucggcaucaagcuuaccauggaguccgccgacuucuacgaggucgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 823 - RNA, 1420 nt, Artificial Sequence
  mRNA product Design2 comprising derived and/or modified sequence from Mus musculus__NP_031704.2 __MmCebpa(15-359) (opt2)
ggggcgcugccuacggagguggcagccaucuccuucucggcaucaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 824 - RNA, 1459 nt, Artificial Sequence
  mRNA product Design2 comprising derived and/or modified sequence from Homo sapiens__NP_004355.2__HsCEBPA (opt2)
ggggcgcugccuacggagguggcagccaucuccuucucggcaucaagcuuaccauggaguccgccgacuucuacgaggccgagccccgcccccccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 825 - RNA, 1417 nt, Artificial Sequence
  mRNA product Design2 comprising derived and/or modified sequence from Homo sapiens__NP_004355.2__HsCEBPA(15-358) (opt2)
ggggcgcugccuacggagguggcagccaucuccuucucggcaucaagcuuaccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 826 - RNA, 1807 nt, Artificial Sequence
  mRNA product Design2 comprising derived and/or modified sequence from Homo sapiens__NP_000448.3__HsHNF4A (opt2)
ggggcgcugccuacggagguggcagccaucuccuucucggcaucaagcuuaccaugcgccucuccaagacccucgucgacauggacauggccgacuacuccgccgcccucgaccccgccuacaccacccucgaguucgagaacguccagguccucaccaugggcaacgacaccucccccuccgagggcaccaaccucaacgcccccaacucccucggcgucuccgcccucugcgccaucugcggcgaccgcgccaccggcaagcacuacggcgccuccuccugcgacggcugcaagggcuucuuccgccgcuccguccgcaagaaccacauguacuccugccgcuucucccgccagugcgucgucgacaaggacaagcgcaaccagugccgcuacugccgccucaagaagugcuuccgcgccggcaugaagaaggaggccguccagaacgagcgcgaccgcaucuccacccgccgcuccuccuacgaggacuccucccuccccuccaucaacgcccuccuccaggccgagguccucucccgccagaucaccucccccgucuccggcaucaacggcgacauccgcgccaagaagaucgccuccaucgccgacgucugcgaguccaugaaggagcagcuccucguccucgucgagugggccaaguacauccccgccuucugcgagcucccccucgacgaccaggucgcccuccuccgcgcccacgccggcgagcaccuccuccucggcgccaccaagcgcuccauggucuucaaggacguccuccuccucggcaacgacuacaucgucccccgccacugccccgagcucgccgagaugucccgcgucuccauccgcauccucgacgagcucguccuccccuuccaggagcuccagaucgacgacaacgaguacgccuaccucaaggccaucaucuucuucgaccccgacgccaagggccucuccgaccccggcaagaucaagcgccuccgcucccagguccaggucucccucgaggacuacaucaacgaccgccaguacgacucccgcggccgcuucggcgagcuccuccuccuccuccccacccuccaguccaucaccuggcagaugaucgagcagauccaguucaucaagcucuucggcauggccaagaucgacaaccuccuccaggagaugcuccucggcggcucccccuccgacgccccccacgcccaccacccccuccacccccaccucaugcaggagcacaugggcaccaacgucaucgucgccaacaccaugcccacccaccucuccaacggccagaugugcgaguggccccgcccccgcggccaggccgccacccccgagaccccccagcccuccccccccggcggcuccggcuccgagcccuacaagcuccuccccggcgccgucgccaccaucgucaagccccucuccgccaucccccagcccaccaucaccaagcaggaggucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 827 - RNA, 1012 nt, Artificial Sequence
  mRNA product Design2 comprising derived and/or modified sequence from Homo sapiens__NP_061986.1__HsFGF21 (opt2)
ggggcgcugccuacggagguggcagccaucuccuucucggcaucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 828 - RNA, 1738 nt, Artificial Sequence
  mRNA product Design2 comprising derived and/or modified sequence from Homo sapiens__NP_078852.3__HsOGFRL1 (opt2)
ggggcgcugccuacggagguggcagccaucuccuucucggcaucaagcuuaccaugggcaaccuccucggcggcgucuccuuccgcgagcccaccaccgucgaggacugcgacuccaccuggcagaccgacuccgagcccgagcccgaggagcccggccccggcggcggcuccgagggccccggccaggaguccgagcagcccgcccagccccccgagcaggccggcggccgccccggcgccucccccgcccccgacgaggacgccgaggccgccggcgccgagcagggcggcgacuccaccgaggccaccgccaagcccaagcgcuccuucuacgccgcccgcgaccucuacaaguaccgccaccaguaccccaacuucaaggacauccgcuaccagaacgaccucuccaaccuccgcuucuacaagaacaagauccccuucaagcccgacggcgucuacaucgaggagguccucuccaaguggaagggcgacuacgagaagcucgagcacaaccacaccuacauccaguggcucuucccccuccgcgagcagggccucaacuucuacgccaaggagcucaccaccuacgagaucgaggaguucaagaagaccaaggaggccauccgccgcuuccuccucgccuacaagaugaugcucgaguucuucggcaucaagcucaccgacaagaccggcaacgucgcccgcgccgucaacuggcaggagcgcuuccagcaccucaacgagucccagcacaacuaccuccgcaucacccgcauccucaagucccucggcgagcucggcuacgaguccuucaaguccccccucgucaaguucauccuccacgaggcccucgucgagaacaccauccccaacaucaagcaguccgcccucgaguacuucgucuacaccauccgcgaccgccgcgagcgccgcaagcuccuccgcuucgcccagaagcacuacacccccuccgagaacuucaucuggggccccccccgcaaggagcaguccgagggcuccaaggcccagaagauguccuccccccucgccuccucccacaacucccagaccuccaugcacaagaaggccaaggacuccaagaacuccuccuccgccguccaccucaacuccaagaccgccgaggacaagaaggucgcccccaaggagcccgucgaggagaccgaccgccccucccccgagcccuccaacgaggccgccaagccccgcaacaccgagaaggacuccaacgccgagaacaugaacucccagcccgagaagaccgucaccacccccaccgagaagaaggaguccgucucccccgagaacaacgaggagggcggcaacgacaaccaggacaacgagaaccccggcaacaccaacugccacgacgucguccucguccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 829 - RNA, 940 nt, Artificial Sequence
  mRNA product Design2 comprising derived and/or modified sequence from Homo sapiens__NP_008842.1__HsRLN1 (opt2)
ggggcgcugccuacggagguggcagccaucuccuucucggcaucaagcuuaccaugccccgccucuuccucuuccaccuccucgaguucugccuccuccucaaccaguucucccgcgccgucgccgccaaguggaaggacgacgucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaucaucaugcucgaguucaucgccaaccucccccccgagcucaaggccgcccucuccgagcgccagcccucccuccccgagcuccagcaguacguccccgcccucaaggacuccaaccucuccuucgaggaguucaagaagcucauccgcaaccgccaguccgaggccgccgacuccaaccccuccgagcucaaguaccucggccucgacacccacucccagaagaagcgccgccccuacgucgcccucuucgagaagugcugccucaucggcugcaccaagcgcucccucgccaaguacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 830 - RNA, 940 nt, Artificial Sequence
  mRNA product Design2 comprising derived and/or modified sequence from Homo sapiens__NP_604390.1__HsRLN2 (opt2)
ggggcgcugccuacggagguggcagccaucuccuucucggcaucaagcuuaccaugccccgccucuucuucuuccaccuccucggcgucugccuccuccucaaccaguucucccgcgccgucgccgacuccuggauggaggaggucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 831 - RNA, 811 nt, Artificial Sequence
  mRNA product Design2 comprising derived and/or modified sequence from Homo sapiens__NP_543140.1__HsRLN3  (opt2)
ggggcgcugccuacggagguggcagccaucuccuucucggcaucaagcuuaccauggcccgcuacaugcuccuccuccuccucgccgucuggguccucaccggcgagcucuggcccggcgccgaggcccgcgccgcccccuacggcguccgccucugcggccgcgaguucauccgcgccgucaucuucaccugcggcggcucccgcuggcgccgcuccgacauccucgcccacgaggccaugggcgacaccuuccccgacgccgacgccgacgaggacucccucgccggcgagcucgacgaggccaugggcuccuccgaguggcucgcccucaccaaguccccccaggccuucuaccgcggccgccccuccuggcagggcacccccggcguccuccgcggcucccgcgacguccucgccggccucuccuccuccugcugcaaguggggcugcuccaaguccgagaucuccucccucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 832 - RNA, 1792 nt, Artificial Sequence
  mRNA product Design2 comprising derived and/or modified sequence from Homo sapiens__NP_002412.1__HsMMP1 (opt2)
ggggcgcugccuacggagguggcagccaucuccuucucggcaucaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 833 - RNA, 1552 nt, Artificial Sequence
  mRNA product Design2 comprising derived and/or modified sequence from Homo sapiens__NP_002412.1__HsMMP1(1-19,100-469) (opt2)
ggggcgcugccuacggagguggcagccaucuccuucucggcaucaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 834 - RNA, 3739 nt, Artificial Sequence
  mRNA product Design2 comprising derived and/or modified sequence from Clostridium histolyticum__BAA77453.1__ColG (opt2)
ggggcgcugccuacggagguggcagccaucuccuucucggcaucaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 835 - RNA, 3463 nt, Artificial Sequence
  mRNA product Design2 comprising derived and/or modified sequence from Clostridium histolyticum__BAA77453.1__HsALB(1-18)_ColG(111-1118) (opt2)
ggggcgcugccuacggagguggcagccaucuccuucucggcaucaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 836 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt2)
ggggcgcugccuacggagguggcagccaucuccuucucggcaucaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 837 - RNA, 3487 nt, Artificial Sequence
  mRNA product Design2 comprising derived and/or modified sequence from Clostridium histolyticum__BAA34542.1__ColH (opt2)
ggggcgcugccuacggagguggcagccaucuccuucucggcaucaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 838 - RNA, 3448 nt, Artificial Sequence
  mRNA product Design2 comprising derived and/or modified sequence from Clostridium histolyticum__BAA34542.1__ColH (opt2)
ggggcgcugccuacggagguggcagccaucuccuucucggcaucaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 839 - RNA, 3382 nt, Artificial Sequence
  mRNA product Design2 comprising derived and/or modified sequence from Clostridium histolyticum__BAA34542.1__HsALB(1-18)_ColH(41-1021) (opt2)
ggggcgcugccuacggagguggcagccaucuccuucucggcaucaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 840 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt2)
ggggcgcugccuacggagguggcagccaucuccuucucggcaucaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 841 - RNA, 1228 nt, Artificial Sequence
  mRNA product Design2 comprising derived and/or modified sequence from Homo sapiens__NP_003801.1__HsTNFSF10 (opt3)
ggggcgcugccuacggagguggcagccaucuccuucucggcaucaagcuuaccauggccaugauggaggugcagggcgggcccagccugggacaaaccugcguccucaucguuauuuucacagugcuucugcaguccuuguguguagcugugacuuacgucuauuuuacgaacgaauuaaagcagaugcaggacaaauacucuaagucagguauagcaugcuuccugaaagaggaugacaguuauugggauccuaaugacgaagagagcaugaacuccccauguuggcaagugaaguggcagcuaagacagcucguuaggaaaaugauccugcggaccucugaagagacaauuucgacugugcaggagaagcaacagaauaucucaccgcuuguccgcgaacgaggcccccagcguguggccgcgcacauuaccgggacaagaggaaggagcaacacccugaguuccccuaauucuaagaacgagaaggcuuugggccggaaaaucaauagcugggaauccucacgcaguggucauagcuuucucucuaaccugcaccugagaaauggggagcucguaauacaugagaaaggauucuacuauaucuacucccagacuuauuuuagguuccaagaagagauuaaggaaaacaccaaaaaugauaagcagaugguucaguacaucuacaaguauacaucauacccagaccccauuuuacugaugaaaagcgcccggaacaguugcuggucuaaggaugcagaguauggccuuuacuccaucuaucaaggcgggauauuugaauugaaagagaaugaccgcauuuucgugagcgucacgaacgagcaccugaucgauauggaccaugaagccucguuuuucggagcuuuucuaguggguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 842 - RNA, 949 nt, Artificial Sequence
  mRNA product Design2 comprising derived and/or modified sequence from Homo sapiens__NP_003801.1__HsTNFSF10(95-281) (opt3)
ggggcgcugccuacggagguggcagccaucuccuucucggcaucaagcuuaccaugaccagcgaagaaacaaucuccacugugcaggagaagcaacagaacauuucuccccuggucagagaaaggggcccucagcggguugccgcucacauaacggggacccgcggacgaucaaauacacucaguagcccaaacuccaaaaaugagaaggcacuuggucguaaaaucaacucuugggaaucgucaagaagcggccauaguuuccuguccaauuugcacuuaaggaacggggagcuggugauucaugagaagggauuuuacuauaucuacucucagacuuauuuccgguuucaagaagagauuaaagaaaauaccaagaacgacaagcagaugguacaguacaucuauaaauacacaagcuauccggaucccauacuacucaugaaguccgcccgcaauucaugcuggaguaaagacgcggaguacggccuguacagcaucuaucagggugggauuuucgagcuuaaggaaaacgauagaaucuuugugucugucaccaaugagcaccugauugacauggaucaugaggcuuccuucuuuggagccuucuuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 843 - RNA, 1000 nt, Artificial Sequence
  mRNA product Design2 comprising derived and/or modified sequence from Homo sapiens__NP_003801.1__HsALB(1-18)_HsTNFSF10(95-281) (opt3)
ggggcgcugccuacggagguggcagccaucuccuucucggcaucaagcuuaccaugaagugggugaccuucaucagccugcucuuucuuuucuccucugccuacucaacaagugaggaaacuauuagcacgguccaggagaaacaacagaacauaucuccccugguuagagaaaggggcccucagcggguggcugcacacaucaccgggacacgcggacgaucuaauacuuugucgucaccaaacagcaagaaugagaaagccuuaggucguaagauuaacaguugggaauccucuagaagcggccauuccuuucugucaaaucuacaccucaggaacggggagcugguaauccaugagaaaggauucuauuacauuuauagucagaccuacuuucgguuccaagaagagaucaaggaaaauacaaagaacgacaaacagauggugcaguauauauacaaguauaccagcuacccggaucccauccuucugaugaaaucugcgcgcaauuccugcuggucaaaggacgcugaguacggcuuguauagcauuuaccagggugggaucuuugagcucaaagaaaacgauagaauuuucgucagugugacuaaugagcaccugaucgacauggaucaugaagccuccuuuuucggagcauuucugguuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 844 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt3)
ggggcgcugccuacggagguggcagccaucuccuucucggcaucaagcuuaccaugaagugggugaccuucaucagccugcucuuucuuuucuccucugccuacucaagaaugaaacagauugaggacaagauagaagagauccugaguaaaauuuaucacaucgaaaacgagauugcuaggaucaagaaauugauaggcgaaacaagcgaggagacuaucuccacgguccaagaaaagcagcagaauauuucucccuuaguucgggagcgcgggccucagcgaguggcagcccauaucaccggaacacgugguagaucgaacacucugucaagcccaaauaguaagaacgaaaaagcgcuaggcaggaagauuaauuccugggagucuagccgguccgggcacucauuucucaguaaccugcaucuucgcaauggagagcugguaauccacgaaaaaggcuucuacuauauauacagccaaaccuauuuuagauuccaggaggaaauuaaggagaacaccaaaaaugauaagcagauggugcaguacaucuauaaguacacaucuuacccggaccccauuuugcucaugaaauccgcuaggaacucaugcuggagcaaggaugccgaauauggucuguacaguaucuaucaagggggaaucuuugagcugaaagagaaugaccggauuuucgucucugugacuaacgaacaucucauagauauggaccacgaggcauccuuuuucggcgccuuuuuaguuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 845 - RNA, 1459 nt, Artificial Sequence
  mRNA product Design2 comprising derived and/or modified sequence from Rattus norvegicus__NP_036656.1__RnCebpa (opt3)
ggggcgcugccuacggagguggcagccaucuccuucucggcaucaagcuuaccauggagagcgccgacuucuacgaagcugagcccagaccuccaauguccucucaucugcagucaccgccccacgcaccuaguaacgccgcguuuggcuucccaaggggagcugggcccgccccuccacccgcaccuccagccgcuccggaaccccucgguggcaucugcgagcacgaaaccagcauugauauauccgcauauaucgacccugccgcuuuuaaugaugaguuccuugccgaccuguuucaacauucucggcagcaggagaaggcgaaagcagccgcugggccagccggaggcgguggggauuucgacuaccccggagcuccugcaggcccaggcggggccgugaugucggcgggagcccacggucccccgccuggcuaugggugugcagcugccggauacuuggauggccgcuuagaaccccuguaugagcgagucggugcuccagcccuacguccucucguuauuaagcaggaacccagagaggaggacgaagcaaaacaacuggcccuugcugggcuguuuccauaccagcccccuccaccgcccccuccaccccauccucacgcgucaccagcacacuuggccgcuccccaucuccaguuccagaucgcccacugcggacaaacaacuaugcaucugcagccgggccacccuacgccacccccuacccccgugccaagcccucaccccgcaccagccaugggcgcugccgggcugccgggaccugguggcagucucaagggguuagcaggaccccauccagaucugaggacaggcggugggggcggaggcggggcgggagcugguaaagccaagaaguccguagacaaaaacucuaaugaguaucgggugcgcagagaaaggaacaauauugcaguccgcaagagccgggauaaagccaagcagcgaaacguggagacucagcaaaaaguucuugaauugaccuccgacaaugauagacugaggaagcggguggagcagcuaucacgugagcucgacacacugcgcggcaucuuuagacagcuucccgaaaguagccuggucaaggcuauggggaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 846 - RNA, 1417 nt, Artificial Sequence
  mRNA product Design2 comprising derived and/or modified sequence from Rattus norvegicus__NP_036656.1__RnCebpa(15-344) (opt3)
ggggcgcugccuacggagguggcagccaucuccuucucggcaucaagcuuaccaugagcucccaucugcagucucccccucacgccccaucaaacgcugcauucggcuuuccgagaggggccggacccgcgccuccacccgcuccuccagccgcacccgagccucucgguggcaucugcgaacacgagaccaguauugacauaagcgccuacaucgauccagcugcauucaaugacgaauuucuugccgaucuguuccaacauuccaggcagcaggagaaggcuaaagccgcggcagggccggccggaggcgguggggacuuugauuaucccggagcuccugccggcccaggcggggcagugaugucugcuggagcccacggucccccuccaggcuacgggugugcggccgcaggauauuuggacggccgguuagaaccccuguacgagcgcgucggugcuccggcccuacgaccucucguuauuaagcaggagccccgugaagaggaugaagcuaaacaacuggcccuugcagggcuguucccauaucagccucccccacccccuccaccgccccauccucacgccucgccagcucacuuggcggcaccccaucuccaguuucagaucgcccacugcggacaaacaacuaugcaucugcagccuggccacccaacgcccccgccuaccccagugcccucaccucaccccgcuccagccaugggcgcagccgggcugccuggacccgguggcagccucaagggguuagcuggaccacauccggaccugagaacaggcggugggggcggaggcggggccggagcagguaaagcgaagaagaguguagauaaaaacuccaaugaguacagggugcggcgcgagagaaacaauauugcugucaggaagucucgggacaaagccaagcagcgcaacguggaaacucagcaaaaaguucuugaguugaccagcgauaaugaccgacugagaaagaggguggaacagcuaucccgggagcucgauacacugcguggcaucuuccgccagcuuccugaaucaagucuggucaaggcaauggggaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 847 - RNA, 1462 nt, Artificial Sequence
  mRNA product Design2 comprising derived and/or modified sequence from Mus musculus__NP_031704.2 __MmCebpa (opt3)
ggggcgcugccuacggagguggcagccaucuccuucucggcaucaagcuuaccauggaaagcgccgacuucuacgagguggaacccagaccuccuaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 848 - RNA, 1420 nt, Artificial Sequence
  mRNA product Design2 comprising derived and/or modified sequence from Mus musculus__NP_031704.2 __MmCebpa(15-359) (opt3)
ggggcgcugccuacggagguggcagccaucuccuucucggcaucaagcuuaccaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 849 - RNA, 1459 nt, Artificial Sequence
  mRNA product Design2 comprising derived and/or modified sequence from Homo sapiens__NP_004355.2__HsCEBPA (opt3)
ggggcgcugccuacggagguggcagccaucuccuucucggcaucaagcuuaccauggagagcgccgacuucuacgaagcugagcccagaccuccaauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 850 - RNA, 1417 nt, Artificial Sequence
  mRNA product Design2 comprising derived and/or modified sequence from Homo sapiens__NP_004355.2__HsCEBPA(15-358) (opt3)
ggggcgcugccuacggagguggcagccaucuccuucucggcaucaagcuuaccauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 851 - RNA, 1807 nt, Artificial Sequence
  mRNA product Design2 comprising derived and/or modified sequence from Homo sapiens__NP_000448.3__HsHNF4A (opt3)
ggggcgcugccuacggagguggcagccaucuccuucucggcaucaagcuuaccaugagacugagcaagacccucguggacauggauauggccgacuacuccgcugcacuugaucccgccuauacaacucuggaguucgaaaacguccagguuuugacgaugggcaaugacaccucuccuucagaggggacaaacuuaaaugcgccaaacagucugggagugagcgcucuaugcgccaucuguggugauagggcaacuggcaaacacuacggggccuccucuugcgacggauguaagggcuuuuuccggcgcucgguacguaaaaaucauauguauucaugccgauuuagcagacaauguguggucgauaaggacaaaaggaaccagugccgguacugucgccucaagaagugcuucagagcugguaugaaaaaggaagcagugcagaaugagagggaucggauuaguacccgccgauccucuuaugaagacagcucccugccgucaauaaacgcccuucugcaggcugagguuuugaguagacaaaucacaagccccgugucugggauuaauggagauaucagggccaaaaagauugcguccaucgcagacgucugugagucaaugaaagaacagcuccuggugcugguagagugggccaaguacauaccugcuuuuugcgaacucccauuagaugaccagguugcccugcuucgggcacacgcuggcgagcauuugcugcuaggcgccaccaagcguagcaugguguucaaagacguccuccugcuugggaacgauuauaucgugccccgccacuguccugagcuggcggaaaugaguagagugucuauuaggaucuuggacgagcucguccugccauuucaggaauuacaaauugaugacaaugaguacgccuaccugaaggcaaucauauucuuugaucccgacgcuaaaggacucuccgauccugguaagauuaaacggcuucgaagccagguucaggugucgcuggaagacuauaucaacgaucgccaguacgacucuagaggcagguucggggaguugcuacugcuccugccaacucuucaauccauuacauggcagaugaucgagcagauccaauuuauuaagcuguucggaauggccaaaauagauaauuugcuccaggaaaugcuguuaggcgguucaccgagugacgcuccccaugcccaccacccucugcauccacaccuaaugcaggagcauauggggaccaacguaaucguggcaaauacgaugcccacucaccucagcaacggacagaugugcgaauggccucggccacgcggccaagccgcuacccccgagacaccgcagccuucucccccaggcggguccggaagcgaaccuuauaagcugcuucccggugcggucgcaacuauugugaagccauugucagccaucccccagccuaccauaacaaaacaggagguuauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 852 - RNA, 1012 nt, Artificial Sequence
  mRNA product Design2 comprising derived and/or modified sequence from Homo sapiens__NP_061986.1__HsFGF21 (opt3)
ggggcgcugccuacggagguggcagccaucuccuucucggcaucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 853 - RNA, 1738 nt, Artificial Sequence
  mRNA product Design2 comprising derived and/or modified sequence from Homo sapiens__NP_078852.3__HsOGFRL1 (opt3)
ggggcgcugccuacggagguggcagccaucuccuucucggcaucaagcuuaccaugggcaaccugcucgggggagugagcuucagagagcccaccacagucgaagacugcgauuccacuuggcagacggacucugagccugaaccagaggaaccgggucccggcgggggaucagagggcccuggucaagagagugaacagccagcccagcccccugagcaggcugggggaaggccaggcgcaagccccgccccugaugaagacgcggaggcugccggcgcagagcaagggggagauuccaccgaagccacagcuaagccaaaacggucuuuuuacgcagcccgcgaccuuuauaaguaccgacaccaguauccgaauuucaaagauauccguuaccagaacgaccugucgaauuugagauuuuauaagaacaaaauucccuucaagccugaugguguuuacauagaggaaguguuaucaaaguggaaaggcgacuaugagaagcuggaacauaaucacacuuacauccaguggcuauuuccacucagggagcaagggcugaacuucuacgcuaaagagcuuaccacauaugaaauugaggaauuuaagaaaaccaaggaggccauccggcgcuuccuguuggcguacaagaugaugcucgaauuuuucggaauuaaacugacugauaagacaggcaauguagcaagagccgugaacuggcaggagagguuucagcaucugaaugagagccagcacaacuaucuccggaucacccgcauauuaaaaagucugggugaacuuggguacgaguccuucaagucucccuuggucaaauuuauccugcaugaagcucuaguggagaauacgauuccuaacaucaagcaaagcgcccucgaauauuucguuuacacuauucgagacagaagggagcggcguaaacugcuucgcuucgcacagaagcacuauaccccauccgagaauuuuaucuggggacccccgagaaaggaacagucagagggcaguaaagcucaaaagaugagcucuccucuggccuccucacacaacagccagacaaguaugcauaaaaaggcgaaagauucuaaaaauuccagcucggccgugcacuugaacucuaagacugcagaagacaagaaggucgcucccaaagagccaguggaggaaaccgacaggccuucccccgagccaucaaacgaagccgcuaagccccggaauacagagaaagauaguaacgccgaaaauaugaacagccagccugagaagaccguaacgacuccaacagagaagaaagaauccguuucuccggagaauaacgaagagggcgggaaugacaaccaggauaaugaaaaccccggaaauaccaacugucaugacgugguccucgugcaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 854 - RNA, 940 nt, Artificial Sequence
  mRNA product Design2 comprising derived and/or modified sequence from Homo sapiens__NP_008842.1__HsRLN1 (opt3)
ggggcgcugccuacggagguggcagccaucuccuucucggcaucaagcuuaccaugcccagacuguuccucuuucaccuucuggaguucugcuuguuacugaaccaguuuagcagggccguggcugcaaaguggaaagacgaugucaucaagcuauguggccgggaacucguucgcgcccaaauugcgauaugcgggauguccaccuggucuaaacgaucacugagucaggaggacgcuccucagacaccacguccgguggccgaaaucguacccagcuucauuaauaaggauacugagacgaucauuaucaugcuugaauuuauagcaaaccugccuccagaguugaaagccgcucucuccgagagacagcccucucugccugaacugcaacaguacgugccagcacucaaggacucgaauuuaucauucgaggaauuuaagaaacugaucaggaaccggcagagcgaggccgcugauaguaaucccuccgagcuuaaguauuugggacuggacacccauucucagaaaaagcgcagaccuuacgucgcccuauucgaaaaauguugccucauugguuguacaaagaggagccuggcgaaguauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 855 - RNA, 940 nt, Artificial Sequence
  mRNA product Design2 comprising derived and/or modified sequence from Homo sapiens__NP_604390.1__HsRLN2 (opt3)
ggggcgcugccuacggagguggcagccaucuccuucucggcaucaagcuuaccaugcccagacuguucuuuuuccaccuccuuggcgugugccuguuguuaaaccaguuuagcagggccgucgcugacuccuggauggaggaaguuaucaagcugugugggcgggagcuagugcgcgcacaaauugccauaugcggaaugucuaccuggucaaaacgaagucucagccaggaagaugcgccucagacaccacguccgguagcugagaucgugcccuccuucauuaauaaggacacugaaacgaucaacaugaugucugaguuugucgccaaucugccucaggagcuuaaacugaccuugucggaaaugcaaccagcacucccccagcugcagcagcaugugccuguucugaaggauucaagccucuuauucgaggaauuuaaaaagcugauuagaaacaggcaaagugaggccgcugacuccucuccaagcgagcuuaaguacuugggucuggauacacacucccggaaaaagcgccagcuauauucagcacucgccaauaaauguugccaugugggcuguacuaagagaagucuggcuagguucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 856 - RNA, 811 nt, Artificial Sequence
  mRNA product Design2 comprising derived and/or modified sequence from Homo sapiens__NP_543140.1__HsRLN3  (opt3)
ggggcgcugccuacggagguggcagccaucuccuucucggcaucaagcuuaccauggccagauacaugcugcuccuucuguuggcugugugggucuuaaccggcgagcuguggcccggggcagaagccagggcggcuccuuauggaguucggcuaugcggucgcgaguucauccgagccgugauuuuuacauguggcgggagccguuggagaagguccgacauacucgcacacgaagccaugggagauacuuucccagacgcugaugcagacgaggauucucuggccggcgaacuugacgaggcuauggguucaagugaguggcuggccuugaccaagagcccgcaggcguuuuaccgggggcgccccuccuggcaaggaacgccuggcguacucagaggcucuagggaugugcuggcagggcugucgucaagcugcuguaaauggggaugcaguaaguccgaaaucucuagccucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 857 - RNA, 1792 nt, Artificial Sequence
  mRNA product Design2 comprising derived and/or modified sequence from Homo sapiens__NP_002412.1__HsMMP1 (opt3)
ggggcgcugccuacggagguggcagccaucuccuucucggcaucaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 858 - RNA, 1552 nt, Artificial Sequence
  mRNA product Design2 comprising derived and/or modified sequence from Homo sapiens__NP_002412.1__HsMMP1(1-19,100-469) (opt3)
ggggcgcugccuacggagguggcagccaucuccuucucggcaucaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 859 - RNA, 3739 nt, Artificial Sequence
  mRNA product Design2 comprising derived and/or modified sequence from Clostridium histolyticum__BAA77453.1__ColG (opt3)
ggggcgcugccuacggagguggcagccaucuccuucucggcaucaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 860 - RNA, 3463 nt, Artificial Sequence
  mRNA product Design2 comprising derived and/or modified sequence from Clostridium histolyticum__BAA77453.1__HsALB(1-18)_ColG(111-1118) (opt3)
ggggcgcugccuacggagguggcagccaucuccuucucggcaucaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 861 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt3)
ggggcgcugccuacggagguggcagccaucuccuucucggcaucaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 862 - RNA, 3487 nt, Artificial Sequence
  mRNA product Design2 comprising derived and/or modified sequence from Clostridium histolyticum__BAA34542.1__ColH (opt3)
ggggcgcugccuacggagguggcagccaucuccuucucggcaucaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 863 - RNA, 3448 nt, Artificial Sequence
  mRNA product Design2 comprising derived and/or modified sequence from Clostridium histolyticum__BAA34542.1__ColH (opt3)
ggggcgcugccuacggagguggcagccaucuccuucucggcaucaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 864 - RNA, 3382 nt, Artificial Sequence
  mRNA product Design2 comprising derived and/or modified sequence from Clostridium histolyticum__BAA34542.1__HsALB(1-18)_ColH(41-1021) (opt3)
ggggcgcugccuacggagguggcagccaucuccuucucggcaucaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 865 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt3)
ggggcgcugccuacggagguggcagccaucuccuucucggcaucaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 866 - RNA, 1228 nt, Artificial Sequence
  mRNA product Design2 comprising derived and/or modified sequence from Homo sapiens__NP_003801.1__HsTNFSF10 (opt4)
ggggcgcugccuacggagguggcagccaucuccuucucggcaucaagcuuaccauggccaugauggaggugcagggcggccccagccugggccagaccugcgugcugaucgugaucuucaccgugcugcugcagagccugugcguggccgugaccuacguguacuucaccaacgagcugaagcagaugcaggacaaguacagcaagagcggcaucgccugcuuccugaaggaggacgacagcuacugggaccccaacgacgaggagagcaugaacagccccugcuggcaggugaaguggcagcugagacagcuggugagaaagaugauccugagaaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 867 - RNA, 949 nt, Artificial Sequence
  mRNA product Design2 comprising derived and/or modified sequence from Homo sapiens__NP_003801.1__HsTNFSF10(95-281) (opt4)
ggggcgcugccuacggagguggcagccaucuccuucucggcaucaagcuuaccaugaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 868 - RNA, 1000 nt, Artificial Sequence
  mRNA product Design2 comprising derived and/or modified sequence from Homo sapiens__NP_003801.1__HsALB(1-18)_HsTNFSF10(95-281) (opt4)
ggggcgcugccuacggagguggcagccaucuccuucucggcaucaagcuuaccaugaagugggugaccuucaucagccugcuguuccuguucagcagcgccuacagcaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 869 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt4)
ggggcgcugccuacggagguggcagccaucuccuucucggcaucaagcuuaccaugaagugggugaccuucaucagccugcuguuccuguucagcagcgccuacagcagaaugaagcagaucgaggacaagaucgaggagauccugagcaagaucuaccacaucgagaacgagaucgccagaaucaagaagcugaucggcgagaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 870 - RNA, 1459 nt, Artificial Sequence
  mRNA product Design2 comprising derived and/or modified sequence from Rattus norvegicus__NP_036656.1__RnCebpa (opt4)
ggggcgcugccuacggagguggcagccaucuccuucucggcaucaagcuuaccauggagagcgccgacuucuacgaggccgagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 871 - RNA, 1417 nt, Artificial Sequence
  mRNA product Design2 comprising derived and/or modified sequence from Rattus norvegicus__NP_036656.1__RnCebpa(15-344) (opt4)
ggggcgcugccuacggagguggcagccaucuccuucucggcaucaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 872 - RNA, 1462 nt, Artificial Sequence
  mRNA product Design2 comprising derived and/or modified sequence from Mus musculus__NP_031704.2 __MmCebpa (opt4)
ggggcgcugccuacggagguggcagccaucuccuucucggcaucaagcuuaccauggagagcgccgacuucuacgagguggagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 873 - RNA, 1420 nt, Artificial Sequence
  mRNA product Design2 comprising derived and/or modified sequence from Mus musculus__NP_031704.2 __MmCebpa(15-359) (opt4)
ggggcgcugccuacggagguggcagccaucuccuucucggcaucaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 874 - RNA, 1459 nt, Artificial Sequence
  mRNA product Design2 comprising derived and/or modified sequence from Homo sapiens__NP_004355.2__HsCEBPA (opt4)
ggggcgcugccuacggagguggcagccaucuccuucucggcaucaagcuuaccauggagagcgccgacuucuacgaggccgagcccagaccccccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 875 - RNA, 1417 nt, Artificial Sequence
  mRNA product Design2 comprising derived and/or modified sequence from Homo sapiens__NP_004355.2__HsCEBPA(15-358) (opt4)
ggggcgcugccuacggagguggcagccaucuccuucucggcaucaagcuuaccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 876 - RNA, 1807 nt, Artificial Sequence
  mRNA product Design2 comprising derived and/or modified sequence from Homo sapiens__NP_000448.3__HsHNF4A (opt4)
ggggcgcugccuacggagguggcagccaucuccuucucggcaucaagcuuaccaugagacugagcaagacccugguggacauggacauggccgacuacagcgccgcccuggaccccgccuacaccacccuggaguucgagaacgugcaggugcugaccaugggcaacgacaccagccccagcgagggcaccaaccugaacgcccccaacagccugggcgugagcgcccugugcgccaucugcggcgacagagccaccggcaagcacuacggcgccagcagcugcgacggcugcaagggcuucuucagaagaagcgugagaaagaaccacauguacagcugcagauucagcagacagugcgugguggacaaggacaagagaaaccagugcagauacugcagacugaagaagugcuucagagccggcaugaagaaggaggccgugcagaacgagagagacagaaucagcaccagaagaagcagcuacgaggacagcagccugcccagcaucaacgcccugcugcaggccgaggugcugagcagacagaucaccagccccgugagcggcaucaacggcgacaucagagccaagaagaucgccagcaucgccgacgugugcgagagcaugaaggagcagcugcuggugcugguggagugggccaaguacauccccgccuucugcgagcugccccuggacgaccagguggcccugcugagagcccacgccggcgagcaccugcugcugggcgccaccaagagaagcaugguguucaaggacgugcugcugcugggcaacgacuacaucgugcccagacacugccccgagcuggccgagaugagcagagugagcaucagaauccuggacgagcuggugcugcccuuccaggagcugcagaucgacgacaacgaguacgccuaccugaaggccaucaucuucuucgaccccgacgccaagggccugagcgaccccggcaagaucaagagacugagaagccaggugcaggugagccuggaggacuacaucaacgacagacaguacgacagcagaggcagauucggcgagcugcugcugcugcugcccacccugcagagcaucaccuggcagaugaucgagcagauccaguucaucaagcuguucggcauggccaagaucgacaaccugcugcaggagaugcugcugggcggcagccccagcgacgccccccacgcccaccacccccugcacccccaccugaugcaggagcacaugggcaccaacgugaucguggccaacaccaugcccacccaccugagcaacggccagaugugcgaguggcccagacccagaggccaggccgccacccccgagaccccccagcccagcccccccggcggcagcggcagcgagcccuacaagcugcugcccggcgccguggccaccaucgugaagccccugagcgccaucccccagcccaccaucaccaagcaggaggugaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 877 - RNA, 1012 nt, Artificial Sequence
  mRNA product Design2 comprising derived and/or modified sequence from Homo sapiens__NP_061986.1__HsFGF21 (opt4)
ggggcgcugccuacggagguggcagccaucuccuucucggcaucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 878 - RNA, 1738 nt, Artificial Sequence
  mRNA product Design2 comprising derived and/or modified sequence from Homo sapiens__NP_078852.3__HsOGFRL1 (opt4)
ggggcgcugccuacggagguggcagccaucuccuucucggcaucaagcuuaccaugggcaaccugcugggcggcgugagcuucagagagcccaccaccguggaggacugcgacagcaccuggcagaccgacagcgagcccgagcccgaggagcccggccccggcggcggcagcgagggccccggccaggagagcgagcagcccgcccagccccccgagcaggccggcggcagacccggcgccagccccgcccccgacgaggacgccgaggccgccggcgccgagcagggcggcgacagcaccgaggccaccgccaagcccaagagaagcuucuacgccgccagagaccuguacaaguacagacaccaguaccccaacuucaaggacaucagauaccagaacgaccugagcaaccugagauucuacaagaacaagauccccuucaagcccgacggcguguacaucgaggaggugcugagcaaguggaagggcgacuacgagaagcuggagcacaaccacaccuacauccaguggcuguucccccugagagagcagggccugaacuucuacgccaaggagcugaccaccuacgagaucgaggaguucaagaagaccaaggaggccaucagaagauuccugcuggccuacaagaugaugcuggaguucuucggcaucaagcugaccgacaagaccggcaacguggccagagccgugaacuggcaggagagauuccagcaccugaacgagagccagcacaacuaccugagaaucaccagaauccugaagagccugggcgagcugggcuacgagagcuucaagagcccccuggugaaguucauccugcacgaggcccugguggagaacaccauccccaacaucaagcagagcgcccuggaguacuucguguacaccaucagagacagaagagagagaagaaagcugcugagauucgcccagaagcacuacacccccagcgagaacuucaucuggggcccccccagaaaggagcagagcgagggcagcaaggcccagaagaugagcagcccccuggccagcagccacaacagccagaccagcaugcacaagaaggccaaggacagcaagaacagcagcagcgccgugcaccugaacagcaagaccgccgaggacaagaagguggcccccaaggagcccguggaggagaccgacagacccagccccgagcccagcaacgaggccgccaagcccagaaacaccgagaaggacagcaacgccgagaacaugaacagccagcccgagaagaccgugaccacccccaccgagaagaaggagagcgugagccccgagaacaacgaggagggcggcaacgacaaccaggacaacgagaaccccggcaacaccaacugccacgacguggugcuggugcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 879 - RNA, 940 nt, Artificial Sequence
  mRNA product Design2 comprising derived and/or modified sequence from Homo sapiens__NP_008842.1__HsRLN1 (opt4)
ggggcgcugccuacggagguggcagccaucuccuucucggcaucaagcuuaccaugcccagacuguuccuguuccaccugcuggaguucugccugcugcugaaccaguucagcagagccguggccgccaaguggaaggacgacgugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaucaucaugcuggaguucaucgccaaccugccccccgagcugaaggccgcccugagcgagagacagcccagccugcccgagcugcagcaguacgugcccgcccugaaggacagcaaccugagcuucgaggaguucaagaagcugaucagaaacagacagagcgaggccgccgacagcaaccccagcgagcugaaguaccugggccuggacacccacagccagaagaagagaagacccuacguggcccuguucgagaagugcugccugaucggcugcaccaagagaagccuggccaaguacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 880 - RNA, 940 nt, Artificial Sequence
  mRNA product Design2 comprising derived and/or modified sequence from Homo sapiens__NP_604390.1__HsRLN2 (opt4)
ggggcgcugccuacggagguggcagccaucuccuucucggcaucaagcuuaccaugcccagacuguucuucuuccaccugcugggcgugugccugcugcugaaccaguucagcagagccguggccgacagcuggauggaggaggugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugaucagaaacagacagagcgaggccgccgacagcagccccagcgagcugaaguaccugggccuggacacccacagcagaaagaagagacagcuguacagcgcccuggccaacaagugcugccacgugggcugcaccaagagaagccuggccagauucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 881 - RNA, 811 nt, Artificial Sequence
  mRNA product Design2 comprising derived and/or modified sequence from Homo sapiens__NP_543140.1__HsRLN3  (opt4)
ggggcgcugccuacggagguggcagccaucuccuucucggcaucaagcuuaccauggccagauacaugcugcugcugcugcuggccgugugggugcugaccggcgagcuguggcccggcgccgaggccagagccgcccccuacggcgugagacugugcggcagagaguucaucagagccgugaucuucaccugcggcggcagcagauggagaagaagcgacauccuggcccacgaggccaugggcgacaccuuccccgacgccgacgccgacgaggacagccuggccggcgagcuggacgaggccaugggcagcagcgaguggcuggcccugaccaagagcccccaggccuucuacagaggcagacccagcuggcagggcacccccggcgugcugagaggcagcagagacgugcuggccggccugagcagcagcugcugcaaguggggcugcagcaagagcgagaucagcagccugugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 882 - RNA, 1792 nt, Artificial Sequence
  mRNA product Design2 comprising derived and/or modified sequence from Homo sapiens__NP_002412.1__HsMMP1 (opt4)
ggggcgcugccuacggagguggcagccaucuccuucucggcaucaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 883 - RNA, 1552 nt, Artificial Sequence
  mRNA product Design2 comprising derived and/or modified sequence from Homo sapiens__NP_002412.1__HsMMP1(1-19,100-469) (opt4)
ggggcgcugccuacggagguggcagccaucuccuucucggcaucaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 884 - RNA, 3739 nt, Artificial Sequence
  mRNA product Design2 comprising derived and/or modified sequence from Clostridium histolyticum__BAA77453.1__ColG (opt4)
ggggcgcugccuacggagguggcagccaucuccuucucggcaucaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 885 - RNA, 3463 nt, Artificial Sequence
  mRNA product Design2 comprising derived and/or modified sequence from Clostridium histolyticum__BAA77453.1__HsALB(1-18)_ColG(111-1118) (opt4)
ggggcgcugccuacggagguggcagccaucuccuucucggcaucaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 886 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt4)
ggggcgcugccuacggagguggcagccaucuccuucucggcaucaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 887 - RNA, 3487 nt, Artificial Sequence
  mRNA product Design2 comprising derived and/or modified sequence from Clostridium histolyticum__BAA34542.1__ColH (opt4)
ggggcgcugccuacggagguggcagccaucuccuucucggcaucaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 888 - RNA, 3448 nt, Artificial Sequence
  mRNA product Design2 comprising derived and/or modified sequence from Clostridium histolyticum__BAA34542.1__ColH (opt4)
ggggcgcugccuacggagguggcagccaucuccuucucggcaucaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 889 - RNA, 3382 nt, Artificial Sequence
  mRNA product Design2 comprising derived and/or modified sequence from Clostridium histolyticum__BAA34542.1__HsALB(1-18)_ColH(41-1021) (opt4)
ggggcgcugccuacggagguggcagccaucuccuucucggcaucaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 890 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt4)
ggggcgcugccuacggagguggcagccaucuccuucucggcaucaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 891 - RNA, 1228 nt, Artificial Sequence
  mRNA product Design2 comprising derived and/or modified sequence from Homo sapiens__NP_003801.1__HsTNFSF10 (opt5)
ggggcgcugccuacggagguggcagccaucuccuucucggcaucaagcuuaccauggccaugauggaggugcagggcgggcccagccugggacaaaccugcguccucaucguuauuuucacagugcugcuucagucccuguguguggcugucacguacguguauuuuaccaacgaacucaagcagaugcaggacaaauacucuaagagcggcaucgccugcuuccugaaagaggaugacuccuauugggauccuaaugacgaagagucuaugaacagcccguguuggcaaguuaaguggcagcuuagacagcuggugcggaaaaugauucuccgcacauccgaagagaccaucucuacaguccaggagaagcaacagaauauuagcccccuggugagagaacgggggccucagcgcguugcggcucacaucaccggaacaagaggccgguccaacacccugagcucucccaauuccaagaacgagaaagcccucgggcgcaagaucaauagcugggaaucuuccagaagcggacauucuuuucuguccaaccuucaucugcggaauggcgagcucgugauucacgagaaaggcuucuacuauaucuacagccagacguauuuucgcuuccaagaagagauuaaggaaaacaccaaaaaugauaagcagaugguccaguacaucuacaaguauacauccuacccugaccccauucugcuuaugaaaucugccagaaacagcugcugguccaaggaugcugaguaugggcuguacagcaucuaucaaggaggcauuuuugaacucaaagagaaugaccggaucuucgugucugugaccaacgagcaccugaucgauauggaccaugaagccuccuuuuucggggcuuuucuggucggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 892 - RNA, 949 nt, Artificial Sequence
  mRNA product Design2 comprising derived and/or modified sequence from Homo sapiens__NP_003801.1__HsTNFSF10(95-281) (opt5)
ggggcgcugccuacggagguggcagccaucuccuucucggcaucaagcuuaccaugaccagcgaggaaacaaucuccacggugcaggagaagcaacagaacauuucuccccuggucagagaacggggcccucagcgcguugccgcucacaucaccgggacaagaggacggagcaauacccucuccucuccgaacagcaaaaaugagaaggcccugggccgcaaaauuaacuccugggaaucuagcagauccgggcauagcuuccuuucuaaucugcaccuccggaacggagagcuggugauccaugagaagggcuuuuacuauauuuacucccagacauauuuccgcuuucaagaagagaucaaagaaaauaccaagaacgacaagcagauggugcaguacaucuauaaauacacaagcuaucccgauccuauucuucugaugaagucugcgagaaauuccugcuggagcaaagacgcugaguacgggcucuacucuaucuaucagggaggcauuuucgagcugaaggaaaacgaucggaucuuugucuccgugaccaaugagcaccugauugacauggaucaugaagccagcuucuuuggcgccuuccucguugggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 893 - RNA, 1000 nt, Artificial Sequence
  mRNA product Design2 comprising derived and/or modified sequence from Homo sapiens__NP_003801.1__HsALB(1-18)_HsTNFSF10(95-281) (opt5)
ggggcgcugccuacggagguggcagccaucuccuucucggcaucaagcuuaccaugaagugggugaccuucaucagccugcucuuucuguucuccucugccuacagcacauccgaggaaacgauuucuaccguccaggagaaacaacagaacaucagcccccuuguuagagaacggggcccucagcgcguggcugcccacauuacagggaccagaggacgguccaauacacugucuagcccgaacuccaagaaugagaaagcgcucggccgcaagaucaacagcugggaaucuuccagaagcgggcauucuuuucuguccaaucuucaucugcggaacggagagcucgugauucacgagaaaggcuucuauuacaucuauagccagaccuacuuucgcuuccaagaagagaucaaggaaaauacaaagaacgacaaacagaugguccaguauauuuacaaguauaccucuuaccccgauccuauccugcugaugaaauccgcuagaaauagcugcugguccaaggacgccgaguacgggcucuauucuauuuaccagggaggcaucuuugagcugaaagaaaacgaucggauuuucgugagcguuacgaaugagcaccuuaucgacauggaucaugaagccuccuuuuucggcgcuuuucugguggggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 894 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt5)
ggggcgcugccuacggagguggcagccaucuccuucucggcaucaagcuuaccaugaagugggugaccuucaucagccugcucuuucuguucuccucugccuacagcagaaugaaacagauugaggacaagaucgaagagauucuuuccaaaaucuaucacauugaaaacgagaucgcucggaucaagaaacugauuggcgaaacaucugaggagacgaucagcaccguccaagaaaagcagcagaauauuucuccccucguucgcgagagagggccucagcggguggccgcgcauaucacaggaacccgcggcagauccaacacacugagcuccccgaauagcaagaacgaaaaagcucuugggcggaagauuaauucuugggaguccagccgcucuggacacuccuuucugagcaaccuccaucugagaaauggcgagcuggugauccacgaaaaaggguucuacuauauuuacucucaaaccuauuuucgguuccaggaggaaaucaaggagaacaccaaaaaugauaagcagaugguccaguacaucuauaaguacacauccuaccccgacccuauucuccugaugaaaagcgcccgcaacuccugcuggucuaaggaugccgaauauggacuuuacagcaucuaucaaggcggcauuuuugagcugaaagagaaugacagaaucuucguguccguuacgaacgaacaucucauugauauggaccacgaggcuagcuuuuucggggccuuucuggugggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 895 - RNA, 1459 nt, Artificial Sequence
  mRNA product Design2 comprising derived and/or modified sequence from Rattus norvegicus__NP_036656.1__RnCebpa (opt5)
ggggcgcugccuacggagguggcagccaucuccuucucggcaucaagcuuaccauggagagcgccgacuucuacgaagcugagcccagaccuccgauguccucucaucugcagagcccuccccacgcccccuccaacgcggcuuuuggcuucccucgcggggccggacccgccccuccgcccgcuccucccgccgcuccugaaccccucggcgggaucugcgagcacgaaaccucuauugauaucagcgccuauauugacccggcggccuuuaaugaugaguuccuggcugaccuuuuucaacauucccggcagcaggagaaggccaaagcugccgcgggaccugccggcgggggaggcgauuucgacuaccccggcgcuccugccgggcccggaggcgcugugaugucugccggggcccacggacccccuccgggcuaugggugugcugcggccggauaccuggauggcagacucgaaccccuguaugagcgggucggcgcuccugcccuucgcccccugguuaucaagcaggaaccuagagaggaggacgaagccaaacaacucgcucuggccgggcuguuucccuaccagccgccucccccucccccucccccgcauccucacgcgagccccgcucaccucgccgcuccccaucugcaguuccagauugcccacugcggacaaacaacgaugcaucuucagccuggccacccgacacccccucccaccccugugcccuccccucaccccgccccggcuaugggggccgcgggacugccuggccccgggggaagccucaagggccuggccggcccucaucccgaucuucggaccgggggaggcgggggaggcggggcuggcgccggaaaagcuaagaagucuguggacaaaaacuccaaugaguaucgcgucagacgggaacgcaacaauaucgccgugagaaagagccgggauaaagcgaagcagcgcaacguugagacacagcaaaaagugcuggaacucaccucugacaaugauagacugcggaagcgcgucgagcagcuguccagagagcucgacacacugcggggcaucuuuagacagcuuccggaaagcucucuggugaaggccauggggaacugugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 896 - RNA, 1417 nt, Artificial Sequence
  mRNA product Design2 comprising derived and/or modified sequence from Rattus norvegicus__NP_036656.1__RnCebpa(15-344) (opt5)
ggggcgcugccuacggagguggcagccaucuccuucucggcaucaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacccugcccccgcuaugggggccgcuggacugccuggccccgggggaucccucaagggccuggccggcccgcauccugaccuuagaaccgggggaggcgggggaggcggggcgggcgccggaaaagcuaaaaagagcguggauaagaacucuaaugaguaccggguccgcagagagcggaacaauaucgccgugcgcaaguccagagacaaagcuaagcagcggaacguugaaacacagcaaaaagugcuggagcucaccagcgauaaugaccgccugagaaagcgggucgaacagcugucucgcgagcucgauacacugagaggcaucuuccggcagcuucccgaauccagccuggugaaggccauggggaacugugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 897 - RNA, 1462 nt, Artificial Sequence
  mRNA product Design2 comprising derived and/or modified sequence from Mus musculus__NP_031704.2 __MmCebpa (opt5)
ggggcgcugccuacggagguggcagccaucuccuucucggcaucaagcuuaccauggagagcgccgacuucuacgaaguggagcccagaccuccgauguccucucaucugcagagcccuccccacgcucccuccaacgccgcguuuggcuucccucgcggggcuggacccgccccuccgcccgccccucccgcugccccugaaccccucggcgggaucugcgagcacgaaaccucuauugauaucagcgcuuauauugacccggccgcguuuaaugaugaguuccuggccgaccuuuuucaacauucccggcagcaggagaaggcuaaagccgcugccggaccugcgggcgggggaggcgauuucgacuaccccggcgccccugcugggcccggaggcgccgucaugucugcuggggcccacggacccccuccgggcuaugggugugccgcugcgggauaccuggauggcagacucgaaccccuguaugagcggguuggcgccccugcccuucgcccccuggugaucaagcaggaaccuagagaggaggacgaagccaaacaacucgcccuggcugggcuguuucccuaccagccgccucccccucccccucccccgcauccucacgccagccccgcgcaccucgcugcuccccaucugcaguuccagauugcccacugcggacaaacaacgaugcaucuucagccuggccacccgacacccccucccaccccugugcccuccccucacgcugcccccgcucugggggccgcgggacucccgggcccugggagcgcccugaagggacuugcuggcgcccaucccgaucugcggaccggcgggggaggcgggggaucuggcgcuggggccggcaaagcgaagaaguccgucgacaaaaacagcaaugaguaucgcgugagacgggaacgcaacaauaucgccguuagaaagucucgggauaaagcuaagcagcgcaacguggagacacagcaaaaaguccucgaacugaccuccgacaaugauagacugcggaagcgcguggagcagcucagcagagagcuggacacacuucggggaaucuuuagacagcugccugaaucuucccucguuaaggccaugggcaacugugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 898 - RNA, 1420 nt, Artificial Sequence
  mRNA product Design2 comprising derived and/or modified sequence from Mus musculus__NP_031704.2 __MmCebpa(15-359) (opt5)
ggggcgcugccuacggagguggcagccaucuccuucucggcaucaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacgccgcuccugcccugggggcugccggacuccccggcccuggguccgcgcugaagggacuugccggcgcucaucccgaccugagaaccggcgggggaggcgggggaagcggcgccggggcuggcaaagccaagaagucuguggauaaaaacuccaaugaguaccggguccgcagagagcggaacaauaucgcggugcgcaagagcagagacaaagccaagcagcggaacguugaaacacagcaaaaagugcucgagcugaccucugauaaugaccgccugagaaagcgggucgaacagcucucccgcgagcuggauacacuuagaggaaucuuccggcagcugccggaaagcucucucgugaaggcuaugggcaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 899 - RNA, 1459 nt, Artificial Sequence
  mRNA product Design2 comprising derived and/or modified sequence from Homo sapiens__NP_004355.2__HsCEBPA (opt5)
ggggcgcugccuacggagguggcagccaucuccuucucggcaucaagcuuaccauggagagcgccgacuucuacgaagcugagcccagaccuccgauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 900 - RNA, 1417 nt, Artificial Sequence
  mRNA product Design2 comprising derived and/or modified sequence from Homo sapiens__NP_004355.2__HsCEBPA(15-358) (opt5)
ggggcgcugccuacggagguggcagccaucuccuucucggcaucaagcuuaccauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 901 - RNA, 1807 nt, Artificial Sequence
  mRNA product Design2 comprising derived and/or modified sequence from Homo sapiens__NP_000448.3__HsHNF4A (opt5)
ggggcgcugccuacggagguggcagccaucuccuucucggcaucaagcuuaccaugagacugagcaagacccucguggacauggauauggccgacuacuccgcugcccuggaucccgcguauacaacgcuugaguucgaaaacguccagguucugaccaugggcaaugacacaucuccuagcgaggggaccaaccucaaugcuccgaacucccugggagugucugcccuuugcgccaucuguggcgaucgggcuacagggaaacacuacggagccagcuccugcgacggcuguaagggguuuuuccgcagaucugugcggaaaaaucauauguauagcugccgcuuuuccagacaaugugucguggauaaggacaaacggaaccagugccgcuacuguagacugaagaagugcuuccgggcuggaaugaaaaaggaagccguucagaaugagcgcgauagaauuagcacccggcgcagcuccuaugaagacagcucucuccccuccaucaacgcgcugcugcaggccgaggugcucagcagacaaauuacaucuccugucuccggcaucaauggcgauauucgggcuaaaaagaucgccagcaucgcugacgugugugaguccaugaaagaacagcugcuuguucugguggagugggccaaguacauucccgcguuuugcgaacucccucuggaugaccaggucgcccuucugcgcgcucacgccggggagcaucuccugcugggagcuaccaagagaucuaugguguucaaagacgugcuccugcuuggcaacgauuauaucgucccccggcacuguccugagcuggccgaaaugagcagaguuuccauucgcauccucgacgagcuggugcuuccguuucaggaacugcaaauugaugacaaugaguacgccuaccucaaggcuaucauuuucuuugaucccgacgcgaaagggcugagcgauccuggaaagaucaaacggcugagaucucaggugcaggucucccucgaagacuauaucaacgaucgccaguacgacagccggggcagauucggggagcugcuucugcuccugcccacgcuucaaucuauuaccuggcagaugaucgagcagauucaauuuaucaagcuguucggaauggccaaaauugauaaucuccugcaggaaaugcugcucggcggcagcccuuccgacgcuccccaugcccaccacccgcugcauccucaccuuaugcaggagcauauggggacaaacgugaucguugccaauaccaugcccacacaccugucuaacggacagaugugcgaauggccucgcccccggggccaagcugccacccccgagacgccucagccgucucccccugggggauccggcagcgaacccuauaagcuccugccuggggcgguggcuacaaucgucaagccccugucugccauuccgcagccuaccaucacaaaacaggaggugauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 902 - RNA, 1012 nt, Artificial Sequence
  mRNA product Design2 comprising derived and/or modified sequence from Homo sapiens__NP_061986.1__HsFGF21 (opt5)
ggggcgcugccuacggagguggcagccaucuccuucucggcaucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 903 - RNA, 1738 nt, Artificial Sequence
  mRNA product Design2 comprising derived and/or modified sequence from Homo sapiens__NP_078852.3__HsOGFRL1 (opt5)
ggggcgcugccuacggagguggcagccaucuccuucucggcaucaagcuuaccaugggcaaccugcucgggggagugagcuucagagagcccaccacagucgaagacugcgauuccacguggcagaccgacucugagccugaaccggaggaacccggcccugggggaggcagcgaggggcccggacaagaguccgaacagccugcccagcccccugagcaggcuggcggccggccgggggccucucccgcgccugaugaagacgcugaggccgccggagcugagcaaggcggggauagcacagaagccaccgcuaagcccaaacgcuccuuuuacgccgcgagagaccuguauaaguaccggcaccaguauccuaauuucaaagauauccgcuaccagaacgaccuuucuaaucugagauuuuauaagaacaaaauucccuucaagccggauggaguuuacaucgaggaagugcucagcaaguggaaaggcgacuaugagaagcuggaacauaaucacacauacauucaguggcuuuuuccucugcgggagcaagggcucaacuucuacgccaaagagcugaccacauaugaaaucgaggaauuuaagaaaaccaaggaggcuauucgcagauuccugcucgccuacaagaugaugcuggaauuuuucggaaucaaacuuacggauaagaccggcaauguggcucgggccgucaacuggcaggagcgcuuucagcaucugaaugagucccagcacaacuaucucagaaucacacggauucugaaaagccuuggcgaacugggguacgagucuuucaagucuccccucgugaaauuuauccugcaugaagcgcugguugagaauaccauuccuaacaucaagcaaagcgcccucgaauauuucguguacacaauucgcgacagacgggagcgcagaaaacugcuucgguucgcucagaagcacuauacccccucugagaauuuuaucuggggacccccuagaaaggaacaguccgagggcagcaaagcccaaaagaugucuuccccgcuggcuagcucccacaacucucagacgagcaugcauaaaaaggccaaagauuccaagaauagcuccuccgccguccaccucaacagcaagacagcugaagacaaaaagguggcgcccaaagagccuguugaggaaaccgaccgccccucuccugagcccagcaacgaagccgcuaagccgcggaauacagagaaagauuccaacgccgaaaauaugaacucucagccugagaagaccgugaccacacccacggagaagaaagaaagcgucuccccugagaauaacgaagaagggggaaaugacaaccaggauaaugagaaccccggcaauaccaacugucaugacguggugcugguccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 904 - RNA, 940 nt, Artificial Sequence
  mRNA product Design2 comprising derived and/or modified sequence from Homo sapiens__NP_008842.1__HsRLN1 (opt5)
ggggcgcugccuacggagguggcagccaucuccuucucggcaucaagcuuaccaugcccagacuguuccucuuucaccuucuugaguucugccugcuccugaaccaguuuagccgggccguggcugccaaguggaaagacgaugucaucaagcuguguggccgcgaacugguuagagcgcaaauugcuaucugcgggauguccaccuggucuaaacggagccucucccaggaggacgccccucagacaccgcgccccguggccgaaauugugccuucuuucaucaauaaggauacggagaccauuaucaucaugcuggaauuuauugcuaaccugcccccugagcucaaagccgcucugagcgagagacagcccucccuuccugaacugcaacaguacgucccggcccucaaggacucuaaucugagcuucgaggaauuuaagaaacuuauccggaaccgccaguccgaggcggccgauagcaaucccucugagcugaaguaucucggacuggacacacauucccagaaaaagagacggccuuacguggcucuguucgaaaaauguugccucauuggcuguaccaagcgcagccuggccaaguauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 905 - RNA, 940 nt, Artificial Sequence
  mRNA product Design2 comprising derived and/or modified sequence from Homo sapiens__NP_604390.1__HsRLN2 (opt5)
ggggcgcugccuacggagguggcagccaucuccuucucggcaucaagcuuaccaugcccagacuguucuuuuuccaccuccugggcgugugccuucugcucaaccaguuuagccgggccgucgcugacuccuggauggaggaaguuaucaagcugugugggcgcgagcuugugagagcccaaauugcgaucugcggaaugucuaccuggagcaaacggucccugucucaggaagaugcuccucagacaccgcgccccguggccgagauugucccuagcuucaucaauaaggacacggaaaccauuaacaugauguccgaguuuguggccaaucucccccaggagcugaaacugacacucucugaaaugcaaccugcucugccccagcuucagcagcauguuccugugcugaaggauagcucccuccuguucgaggaauuuaaaaagcugaucagaaaccggcaaagcgaggccgcugacucuuccccgagcgagcuuaaguaccucggccuggauacccacucucgcaaaaagagacagcuguauuccgcccucgcgaauaaauguugccaugucggguguacaaagcggagccuggcccgcuucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 906 - RNA, 811 nt, Artificial Sequence
  mRNA product Design2 comprising derived and/or modified sequence from Homo sapiens__NP_543140.1__HsRLN3  (opt5)
ggggcgcugccuacggagguggcagccaucuccuucucggcaucaagcuuaccauggccagauacaugcugcuccugcuucuggcuguguggguccucaccggcgagcuguggcccggggccgaagcgcgggcugccccuuauggaguucgccuuugcggcagagaguucauccgggccgugauuuuuacaugugggggaagccgcuggagacgguccgacauccuggcucacgaagccaugggcgauacguucccggacgcugaugccgacgaggauucucucgcgggggaacuggacgaggccaugggaagcuccgaguggcuggcucucaccaagucuccccaggccuuuuaccgcggcagaccuagcuggcaaggcacacccggggugcugcggggaucccgcgauguccuugcuggccugucuagcuccugcuguaaaugggggugcagcaagucugaaauuuccagccucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 907 - RNA, 1792 nt, Artificial Sequence
  mRNA product Design2 comprising derived and/or modified sequence from Homo sapiens__NP_002412.1__HsMMP1 (opt5)
ggggcgcugccuacggagguggcagccaucuccuucucggcaucaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 908 - RNA, 1552 nt, Artificial Sequence
  mRNA product Design2 comprising derived and/or modified sequence from Homo sapiens__NP_002412.1__HsMMP1(1-19,100-469) (opt5)
ggggcgcugccuacggagguggcagccaucuccuucucggcaucaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 909 - RNA, 3739 nt, Artificial Sequence
  mRNA product Design2 comprising derived and/or modified sequence from Clostridium histolyticum__BAA77453.1__ColG (opt5)
ggggcgcugccuacggagguggcagccaucuccuucucggcaucaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 910 - RNA, 3463 nt, Artificial Sequence
  mRNA product Design2 comprising derived and/or modified sequence from Clostridium histolyticum__BAA77453.1__HsALB(1-18)_ColG(111-1118) (opt5)
ggggcgcugccuacggagguggcagccaucuccuucucggcaucaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 911 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt5)
ggggcgcugccuacggagguggcagccaucuccuucucggcaucaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 912 - RNA, 3487 nt, Artificial Sequence
  mRNA product Design2 comprising derived and/or modified sequence from Clostridium histolyticum__BAA34542.1__ColH (opt5)
ggggcgcugccuacggagguggcagccaucuccuucucggcaucaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 913 - RNA, 3448 nt, Artificial Sequence
  mRNA product Design2 comprising derived and/or modified sequence from Clostridium histolyticum__BAA34542.1__ColH (opt5)
ggggcgcugccuacggagguggcagccaucuccuucucggcaucaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 914 - RNA, 3382 nt, Artificial Sequence
  mRNA product Design2 comprising derived and/or modified sequence from Clostridium histolyticum__BAA34542.1__HsALB(1-18)_ColH(41-1021) (opt5)
ggggcgcugccuacggagguggcagccaucuccuucucggcaucaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 915 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt5)
ggggcgcugccuacggagguggcagccaucuccuucucggcaucaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 916 - RNA, 1228 nt, Artificial Sequence
  mRNA product Design2 comprising derived and/or modified sequence from Homo sapiens__NP_003801.1__HsTNFSF10 (opt6)
ggggcgcugccuacggagguggcagccaucuccuucucggcaucaagcuuaccauggcaaugauggaaguacaaggaggaccaucacuaggacaaacaugcguacuaauaguaauauucacaguacuacuccaaucacuaugugucgcagucacauacguauacuucacaaacgaauuaaaacaaaugcaagauaaauacucaaaaucaggaauagcuugcuucuuaaaagaagacgacucauacugggaccccaacgacgaagaaucaaugaauagcccaugcuggcaaguaaaauggcaacuaagacaauuaguaagaaaaaugauacuaagaacaucagaagaaacaauaucaacaguacaagaaaaacaacaaaacauaucaccccuaguaagagaaagaggaccacaaagaguagcagcacacauaacaggaacaagaggaagaagcaacacacuaucaaguccaaacagcaaaaacgaaaaagcacucggaagaaaaauaaacucaugggaauccagcagaagcggacacucauucuuaucaaaccuacauuuacgaaauggagaauuaguaauacacgaaaaaggauucuacuacauauacucacaaaccuacuucagauuccaagaagaaauaaaagaaaacaccaaaaacgacaaacaaaugguacaauacauauacaaauacacaucauauccagacccaauacuauuaaugaaaucagcaagaaauagcugcuggucaaaagacgcagaauacggacuauacucaauauaccaaggcggaauauucgaauuaaaagaaaacgacagaauauucguaucaguaacaaacgaacaccuaauagacauggaccacgaagcaaguuucuucggugcauucuuaguaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 917 - RNA, 949 nt, Artificial Sequence
  mRNA product Design2 comprising derived and/or modified sequence from Homo sapiens__NP_003801.1__HsTNFSF10(95-281) (opt6)
ggggcgcugccuacggagguggcagccaucuccuucucggcaucaagcuuaccaugacaagcgaagaaacaauaagcacaguacaagaaaaacaacaaaacauaagcccccuaguaagagaaagaggaccacaacgaguagcagcacacauaacaggaacaagaggaagaucaaacacacuaagcucaccaaacaguaaaaacgaaaaagcauuaggaagaaaaauaaacucaugggaaucaagcagaagcggacacucauucuuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaaguuacccagacccaauacuacuaaugaaaucagcaagaaacagcugcuggucaaaagacgccgaauacggacuauacucaauauaccaaggaggaauauucgaacuaaaagaaaacgacagaauauucgucucaguaacaaacgaacacuuaauagacauggaccacgaagcaucauucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 918 - RNA, 1000 nt, Artificial Sequence
  mRNA product Design2 comprising derived and/or modified sequence from Homo sapiens__NP_003801.1__HsALB(1-18)_HsTNFSF10(95-281) (opt6)
ggggcgcugccuacggagguggcagccaucuccuucucggcaucaagcuuaccaugaaauggguaacauucauauccuuacuauuccuauucucaucagcauacucaacaucagaagaaacaauaucaacaguacaagaaaaacaacaaaacauauccccacuuguaagagaacgaggaccacaaagaguagcagcacacauaacaggaacaagaggaagauccaacacacuaucauccccaaacucaaaaaacgaaaaagcacuaggaagaaaaauaaacucaugggaaucauccagaucaggacacagcuuccuaucaaacuuacacuuaagaaacggagaacuuguaauacacgaaaaaggauucuacuacauauacucacaaacauacuucagauuccaagaagaaauaaaagaaaacacaaaaaacgacaaacaaaugguacaauacauauacaaauauacaucauacccagacccaauacuacuaaugaaaucagcaagaaacucaugcuggucaaaagacgcagaauacggacuauacagcauauaccaaggaggaauauucgaacuaaaagaaaacgacagaauauucguaucaguaacaaacgaacacuuaauagacauggaccacgaagcauccuucuucggagccuuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 919 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt6)
ggggcgcugccuacggagguggcagccaucuccuucucggcaucaagcuuaccaugaaauggguaacauucauaucacucuuauucuuauucucaagcgcauacucaagaaugaaacaaauagaagacaaaauagaagaaauauuaucaaaaauauaccauaucgaaaacgaaauagcaagaauaaaaaaauuaauaggagaaacaucagaagaaacaauaagcacgguacaagaaaaacaacaaaacauaagcccacuuguaagagaaagaggaccacaaagaguagcagcacacauaaccggaacaagaggcagaagcaauacacuaucaucaccaaauagcaaaaacgaaaaagcacuaggaagaaaaauaaacaguugggaaucaagcagaagcggacacucauuccuaagcaaccuacaccuaaggaacggagaauuaguaauacacgaaaaaggauuuuacuacauauacucacaaacauacuucagauuccaagaagaaauaaaagaaaacacaaaaaacgacaaacaaaugguacaauacauauacaaauacacaagcuauccagacccaauacuacuaaugaaaagugcaagaaauagcugcuggucaaaagacgccgaauacggacuauacagcauauaccaaggaggaauauucgaauuaaaagaaaacgaccgaauauuuguaaguguaacaaacgaacaccuaauagacauggaccacgaagcuagcuucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 920 - RNA, 1459 nt, Artificial Sequence
  mRNA product Design2 comprising derived and/or modified sequence from Rattus norvegicus__NP_036656.1__RnCebpa (opt6)
ggggcgcugccuacggagguggcagccaucuccuucucggcaucaagcuuaccauggaaucagcugacuuuuaugaagcagaaccaagaccaccaaugucuucacaucuacaaaguccuccacaugcaccaucuaaugcagcuuuuggauuuccaagaggagcaggaccugcaccaccaccagcaccuccagcagcucccgaaccccuaggagguauaugugaacaugaaacaaguauagauauaagugcauacauagauccagcagcauuuaacgacgaauuuuuagcugaccuauuucaacauuccagacaacaagaaaaagcaaaagcugcagccggaccagcaggaggaggaggugauuucgacuauccaggagcaccagcaggaccuggcggagcaguaaugucagcaggagcacauggaccaccaccuggauacggaugugcagcagcuggauauuuagacggaagauuagaaccauuauaugaaagaguaggagcaccagcauuacguccauuaguaauaaaacaagaaccaagagaagaagacgaagcaaaacaacuagcacuugcagguuuauuuccauaucaaccaccuccuccaccaccaccaccacacccacacgccucaccagcacauuuagcagcaccucaucuacaauuucaaauagcacauuguggacaaacgacuaugcaucuacaaccaggacauccaacaccaccaccaacaccaguuccaucaccucauccagcacccgcuaugggagcagcaggccuaccaggaccaggagguucgcuaaaaggacucgcaggaccccauccagauuuaagaacaggagguggaggaggaggaggagcaggagcuggaaaagcaaaaaaaucaguagauaaaaacucaaacgaauacagagucagaagagaaagaaauaauauagcuguaagaaaaucaagagacaaagcaaaacaaagaaauguagaaacacaacaaaaaguacuugaauuaacaucugacaaugauagauuaagaaaaagaguagaacaauuaucaagagaacuagacacacuaagaggaauauuuagacaacuaccagaaucaagcuuaguuaaagccauggguaauugugcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 921 - RNA, 1417 nt, Artificial Sequence
  mRNA product Design2 comprising derived and/or modified sequence from Rattus norvegicus__NP_036656.1__RnCebpa(15-344) (opt6)
ggggcgcugccuacggagguggcagccaucuccuucucggcaucaagcuuaccaugaguucacauuuacaaagccccccucaugcaccaucaaaugcagcauuuggauucccaagaggugcaggaccagcaccuccaccagcaccaccagcugcaccagaaccucuaggaggaauaugugaacaugaaacaucuauagauauaucagcauauauagauccugcagcauucaaugaugaauuuuuagcagauuuauuucaacacucaagacaacaagaaaaagcaaaagcagcagcuggaccagcagguggaggaggagacuuugauuauccaggagcaccagcagguccuggcggagcaguaaugucagcaggagcacauggacccccuccuggauauggaugugcagcagcuggauauuuagacggaagauuagaaccauuauacgaaagaguaggagcaccugcauuaagaccauuaguaaucaaacaagaaccaagggaagaagaugaagcaaaacaauuagcauuagcuggauuauuuccauaucaaccaccaccaccaccaccaccaccacauccacaugcaucaccagcucauuuagcagcaccacaccuacaauuucaaauagcacauuguggacaaacuacuaugcauuuacaaccaggucauccaacaccaccaccaacaccaguaccaucaccacauccugcuccagcaaugggagcagcaggauuaccaggaccaggaggaucacuuaaagguuuagcaggaccacacccagaucuucgaacaggaggaggaggcggagguggugcaggagcaggaaaagccaaaaaaucaguugacaaaaauagcaaugaauacagaguaagacgagaaagaaauaauauagcaguaagaaaaagcagagauaaagcaaaacaaagaaauguagaaacacaacaaaaaguauuagaauuaacaucagacaaugaucguuuaagaaaacgaguagaacaacuuaguagagaauuagacacauuaagaggaauuuuuagacaauuaccagaaucaucauuaguaaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 922 - RNA, 1462 nt, Artificial Sequence
  mRNA product Design2 comprising derived and/or modified sequence from Mus musculus__NP_031704.2 __MmCebpa (opt6)
ggggcgcugccuacggagguggcagccaucuccuucucggcaucaagcuuaccauggaaucagcagauuuuuaugaaguagaaccacgaccaccuaugaguucucacuuacaaaguccaccacacgcaccaucaaaugcugcauuuggcuucccuagaggcgcaggaccagcaccaccuccugcaccaccagccgcaccagaaccauuaggaggaauuugugaacaugaaacaucuauagauauaucagcauauauagacccagcagcauucaaugaugaauuuuuagcagaucuauuccaacacaguagacaacaagaaaaagcuaaagcagcagcaggaccagcaggaggaggcggagacuuugauuauccuggagcaccugcaggaccuggaggugcaguaaugucagcaggugcacaugguccaccaccuggauauggaugugcugcagcaggauaccuagauggaagauuagaaccacuauaugaaagaguuggugcaccugccuuaagaccauuagucauuaaacaagaaccaagagaagaagaugaagcaaaacaauuagcacuagcaggauuauucccauaucaaccaccacccccccccccaccaccacauccacaugcaucaccagcacauuuagcagcuccacauuuacaauuucaaauagcacauuguggccaaacaacuaugcauuugcaaccaggacauccaacaccaccaccaacaccagucccaucuccucacgcugcaccagcacuuggugcagcaggauuaccaggaccaggaagugcacuuaaaggauuggcaggagcccaucccgauuuaagaacaggaggagguggaggaggaaguggagcaggugcaggaaaagcaaaaaaaaguguagauaaaaauagcaacgaauauagaguacgaagagaaagaaauaauauagcaguaagaaaaucaagagauaaagcaaaacaaaggaauguugaaacacaacaaaaaguauuagaauuaacauccgauaaugacagauuacgaaaaagaguagaacaacucucaagagaauuagauacacuaagagguauauuuagacaauuaccagaaucaucauuaguuaaagcaaugggaaauugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 923 - RNA, 1420 nt, Artificial Sequence
  mRNA product Design2 comprising derived and/or modified sequence from Mus musculus__NP_031704.2 __MmCebpa(15-359) (opt6)
ggggcgcugccuacggagguggcagccaucuccuucucggcaucaagcuuaccaugucuagccauuuacaaucaccaccacaugcaccaucaaaugcugcauuuggcuuucccagaggagcagguccugcaccacccccagcuccuccagccgcuccugaaccauuaggaggaauaugugaacaugaaacaucaauagacauuucagcauauauagacccagcagcauuuaaugaugaauuucuagcagauuuauuucaacacagcagacaacaagaaaaagccaaagcagcagcaggaccagcaggaggugguggagauuuugauuacccaggcgcaccagcaggucccggaggugcaguuaugucagccggagcucauggaccaccaccuggcuacggcugugcagcagcaggauauuuagacgguagacuagaaccauuauacgaaagaguaggagccccagcacuaagaccauuaguaauaaaacaagaaccaagagaagaagaugaagcaaaacaauuagcauuagcuggauuauuuccauaucaaccaccaccuccaccuccaccaccacauccccaugcuucaccagcacaucuugcagcaccacauuuacaauuucaaauagcucauuguggacaaacaacaaugcaccuacaaccaggacacccaacaccaccaccuacuccaguaccauccccacaugcugcaccagcacuaggagcagcuggccuuccaggcccaggaucugcacuuaaaggauuagcaggagcucauccggauuuaagaacaggaggaggaggaggaggaucaggagcaggagcagguaaagcuaaaaaaucaguagauaaaaauucaaacgaauacagaguaagacgagaacgaaauaacauagccguaagaaaaucaagagauaaagcaaaacaaagaaacguagaaacacaacaaaaaguauuagaacuaacaagugauaaugaucgacuaagaaaaagaguagaacaacuaucaagagaauuagauacacuucguggaauauuuagacaauuaccagaaucaucauuaguuaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 924 - RNA, 1459 nt, Artificial Sequence
  mRNA product Design2 comprising derived and/or modified sequence from Homo sapiens__NP_004355.2__HsCEBPA (opt6)
ggggcgcugccuacggagguggcagccaucuccuucucggcaucaagcuuaccauggaaucagcagauuuuuacgaagcagaaccaagacccccaaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 925 - RNA, 1417 nt, Artificial Sequence
  mRNA product Design2 comprising derived and/or modified sequence from Homo sapiens__NP_004355.2__HsCEBPA(15-358) (opt6)
ggggcgcugccuacggagguggcagccaucuccuucucggcaucaagcuuaccaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 926 - RNA, 1807 nt, Artificial Sequence
  mRNA product Design2 comprising derived and/or modified sequence from Homo sapiens__NP_000448.3__HsHNF4A (opt6)
ggggcgcugccuacggagguggcagccaucuccuucucggcaucaagcuuaccaugcgauuaucaaaaacacucguagauauggauauggcggacuacucagcagcauuagaccccgcauauaccacauuagaauuugaaaacguccaaguauuaacaaugggaaaugacacaucucccucagaaggaacaaaccucaacgcaccaaacucucuaggaguaucagcucuaugcgccauaugcggagaccgagccacaggaaaacacuacggagcaucaucaugugacgguugcaaaggauucuucagaagaucuguaagaaaaaaucacauguacucaugcagauucucuagacaaugcguugucgacaaagacaaaagaaaucaaugcagauacugcagacugaaaaaaugcuucagagcaggaaugaaaaaagaagcaguacaaaacgaaagagauagaauuuccacacguagaucuucauaugaagacuccucauuaccaucaauaaaugcacuauuacaagcagaaguacuaucacgacaaauaaccucccccguaucaggaauuaacggagauauaagagcaaaaaaaauagcaucaauagccgauguaugcgagagcaugaaagaacaacuauuaguacuuguagaaugggcaaaauacaucccagcuuuuugcgaauuaccguuagaugaccaaguagcauuauuaagagcacacgcaggagaacaucuauuacucggugcaacaaaaagauccaugguauucaaagacguccuacuucuaggaaacgacuacauaguaccacgccacugccccgaauuagcagaaauguccagaguuaguauaagaauacuagacgaauuaguacuaccauuccaagaacuacaaauagaugacaacgaauaugcauauuuaaaagcaaucaucuucuucgauccagacgcaaaaggacuauccgauccugguaaaauaaaaagguuaagaucacaaguacaaguaucacuugaggauuacaucaacgauagacaauacgacucacgagguagguuuggagaacuauuacuuuuauuaccaaccuuacaaucaaucacauggcaaaugauagaacaaauacaauucaucaaacuauucggaauggccaaaauagacaaccuacuacaagaaauguuauuaggaggaucaccaucugacgcaccacacgcacaccauccacuacacccacaucuaaugcaagaacacauggguacaaacguaauagucgcaaauacaaugccaacacaccuaucuaacggacaaaugugcgaauggccacgcccacgaggacaagcagcaacaccugaaaccccacaaccaucaccacccggagguucaggaucagaaccauacaaacuccuaccuggagcaguagcaacaauaguaaagccauuaucagcaauaccacaaccaacaauaacaaaacaagaaguaauauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 927 - RNA, 1012 nt, Artificial Sequence
  mRNA product Design2 comprising derived and/or modified sequence from Homo sapiens__NP_061986.1__HsFGF21 (opt6)
ggggcgcugccuacggagguggcagccaucuccuucucggcaucaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 928 - RNA, 1738 nt, Artificial Sequence
  mRNA product Design2 comprising derived and/or modified sequence from Homo sapiens__NP_078852.3__HsOGFRL1 (opt6)
ggggcgcugccuacggagguggcagccaucuccuucucggcaucaagcuuaccaugggaaauuuauuagguggaguauccuucagagaaccaacaacagucgaagacugugacagcacauggcaaacggacucagaaccagaaccagaagaaccaggaccaggaggaggaucagaaggaccaggucaagaaucagaacaaccagcacaaccaccagaacaagcaggaggaagaccaggugcauccccagccccagacgaagacgcagaagcagccggagcagaacaaggaggugacaguacagaagcuaccgcaaaacccaaacgaucauucuacgcagcaagagaccuuuacaaauacagacaccaguauccaaacuucaaagacauuagauaccaaaaugauuuaagcaaccuacgauuuuauaaaaauaaaauaccauucaaacccgacggagucuacauagaagaaguacuaucaaaauggaaaggcgauuacgaaaaauuagaacauaaccacacauacauacaaugguuauucccacucagagaacaaggauuaaauuuuuaugcaaaagaacuuacaacauacgaaauagaagaauuuaaaaaaacaaaagaagcaauacgcagauuccuacuggcauacaaaaugaugcuagaauuuuucggcauaaaauuaacagacaaaaccggcaacguagcaagagcaguaaacuggcaagaacgauuccaacaucuaaacgaaagccaacacaacuaccugagaauaacacgcauacuaaaaucacuaggagaacuaggcuaugaauccuuuaaaagcccauuaguaaaauucauacuacaugaagccuuaguagaaaacacaauaccaaacauaaaacaaucagcauuagaauacuucguauauacaauaagagacagaagagaaagaagaaagcuauuacgauuugcacaaaaacauuacacacccucagaaaacuucaucuggggcccaccaagaaaagaacaaucagaaggaucaaaagcacaaaaaaugagcucaccacuagcaaguucacauaacucacaaacauccaugcauaaaaaagcaaaagauucaaaaaauuccucaucagcaguacaccuaaacaguaaaacugccgaagacaaaaaaguagcaccaaaagaaccaguagaagaaacagacagacccucaccugaaccuagcaacgaagcagcaaaaccaagaaauacagaaaaagauucaaacgcagaaaauaugaacucacaaccagaaaaaacugucaccacaccaacagaaaaaaaagaaucaguaucaccagaaaauaacgaagaaggaggcaacgauaaccaagacaacgaaaacccagguaacacaaacugucacgacgucguauuaguucaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 929 - RNA, 940 nt, Artificial Sequence
  mRNA product Design2 comprising derived and/or modified sequence from Homo sapiens__NP_008842.1__HsRLN1 (opt6)
ggggcgcugccuacggagguggcagccaucuccuucucggcaucaagcuuaccaugccaagacuauucuuauuccaccuauuagaauuuugccuacuacuaaaccaauuuuccagagcaguagcagcaaaauggaaagacgacguaauaaaauuaugcggaagagaacucguaagagcacaaauagcaauaugcggaaugucaacauggucaaaaagaucacuaucacaagaagacgcaccacaaacaccaagaccaguagcagaaauagucccaucauucauaaacaaagacacagaaacaauaauaauaaugcuagaauuuauagcaaacuuaccacccgaacuaaaagcagcacuaucagaaagacaaccaucacuaccagaacuacaacaauacgucccagcacuaaaagacucaaaccuauccuucgaagaauuuaaaaaacucauaagaaacagacaaucagaagcagcagacucaaacccauccgaacuaaaauaccuaggacuagacacacacucacaaaaaaaaagaagaccauacguagcccuauucgaaaaaugcugccuaauaggauguacaaaacgcucacuagcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 930 - RNA, 940 nt, Artificial Sequence
  mRNA product Design2 comprising derived and/or modified sequence from Homo sapiens__NP_604390.1__HsRLN2 (opt6)
ggggcgcugccuacggagguggcagccaucuccuucucggcaucaagcuuaccaugccaagacuauucuucuuccaccuacuaggaguaugccuacuccuaaaccaauucuccagagcaguagcagacucauggauggaagaaguaauaaaacuaugcggaagagaacuuguaagagcacaaauagcaauaugcggaauguccacauggucaaaaagaucacuaucacaagaagacgcaccacaaacaccaagaccaguagcagaaauaguaccaucauucauaaacaaagauacagaaacaauaaacaugaugucagaauuugucgcaaaccuaccacaagaauuaaaacuaacauuaucagaaaugcaaccagcccuaccacaacuacaacaacacguacccguacuaaaagacucaucauuacuauucgaagaauuuaaaaaacuaauaagaaacagacaaucagaagcagcagacagcucaccaucagaauuaaaauaccucggacuagacacacacucaagaaaaaaaagacaauuauacucagcacuagcaaacaaaugcugccacguaggaugcacaaaaagaucacuagccagauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 931 - RNA, 811 nt, Artificial Sequence
  mRNA product Design2 comprising derived and/or modified sequence from Homo sapiens__NP_543140.1__HsRLN3  (opt6)
ggggcgcugccuacggagguggcagccaucuccuucucggcaucaagcuuaccauggcaagauauauguuauuauuauuauuagcaguauggguacuaacaggagaauuauggccaggagcagaagcaagagcagcaccauauggaguaagauuguguggaagagaauuuauaagagcaguaauauuuacauguggaggaagcagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaggcauuuuauagaggaagaccaaguuggcaaggaacaccaggaguauuaagaggaagcagagauguauuagcaggauuaaguaguaguuguuguaaauggggauguaguaaaagugaaauaaguaguuuauguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 932 - RNA, 1792 nt, Artificial Sequence
  mRNA product Design2 comprising derived and/or modified sequence from Homo sapiens__NP_002412.1__HsMMP1 (opt6)
ggggcgcugccuacggagguggcagccaucuccuucucggcaucaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 933 - RNA, 1552 nt, Artificial Sequence
  mRNA product Design2 comprising derived and/or modified sequence from Homo sapiens__NP_002412.1__HsMMP1(1-19,100-469) (opt6)
ggggcgcugccuacggagguggcagccaucuccuucucggcaucaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 934 - RNA, 3739 nt, Artificial Sequence
  mRNA product Design2 comprising derived and/or modified sequence from Clostridium histolyticum__BAA77453.1__ColG (opt6)
ggggcgcugccuacggagguggcagccaucuccuucucggcaucaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 935 - RNA, 3463 nt, Artificial Sequence
  mRNA product Design2 comprising derived and/or modified sequence from Clostridium histolyticum__BAA77453.1__HsALB(1-18)_ColG(111-1118) (opt6)
ggggcgcugccuacggagguggcagccaucuccuucucggcaucaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 936 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt6)
ggggcgcugccuacggagguggcagccaucuccuucucggcaucaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 937 - RNA, 3487 nt, Artificial Sequence
  mRNA product Design2 comprising derived and/or modified sequence from Clostridium histolyticum__BAA34542.1__ColH (opt6)
ggggcgcugccuacggagguggcagccaucuccuucucggcaucaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 938 - RNA, 3448 nt, Artificial Sequence
  mRNA product Design2 comprising derived and/or modified sequence from Clostridium histolyticum__BAA34542.1__ColH (opt6)
ggggcgcugccuacggagguggcagccaucuccuucucggcaucaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 939 - RNA, 3382 nt, Artificial Sequence
  mRNA product Design2 comprising derived and/or modified sequence from Clostridium histolyticum__BAA34542.1__HsALB(1-18)_ColH(41-1021) (opt6)
ggggcgcugccuacggagguggcagccaucuccuucucggcaucaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 940 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt6)
ggggcgcugccuacggagguggcagccaucuccuucucggcaucaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 941 - RNA, 1228 nt, Artificial Sequence
  mRNA product Design2 comprising derived and/or modified sequence from Homo sapiens__NP_003801.1__HsTNFSF10 (opt7)
ggggcgcugccuacggagguggcagccaucuccuucucggcaucaagcuuaccauggccaugauggaggugcagggcgggcccagccugggucaaaccugcguccucaucgugauuuucacuguacuguugcagucccuguguguggcagucaccuacguguauuuuacgaacgaacucaagcagaugcaggacaaauacaguaagagcggcaucgccugcuuccugaaagaggaugacuccuauugggauccaaaugacgaagagaguaugaacagcccguguuggcaagugaaguggcaguugaggcagcugguccggaaaaugauucuccgcacuuccgaagagaccaucagcaccgugcaggagaagcaacagaauauuaguccccugguaagggaacgggggccacagcgcguggcggcccacaucacuggcaccaggggucgguccaacacgcugagcucccccaauagcaagaacgagaaagcacucgggcgcaagaucaauaguugggaauccagcagguccggccauaguuuucugagcaacuugcaucugcggaauggcgagcucgucauucacgagaaaggguucuacuauaucuacucccagacuuauuuucgcuuccaagaagagauuaaggaaaacaccaaaaaugauaagcagauggugcaguacaucuacaaauauacuagcuacccagaccccauucugcugaugaagagugccaggaacuccugcuggagcaaggaugcagaguaugguuuguacaguaucuaucaaggcgggauuuuugaacucaaagagaaugaccggaucuucguguccgucaccaacgagcaccugaucgauauggaccaugaagccagcuuuuucggcgcguuucugguggguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 942 - RNA, 949 nt, Artificial Sequence
  mRNA product Design2 comprising derived and/or modified sequence from Homo sapiens__NP_003801.1__HsTNFSF10(95-281) (opt7)
ggggcgcugccuacggagguggcagccaucuccuucucggcaucaagcuuaccaugaccagcgaggaaacuaucuccaccgugcaggagaagcaacagaacauuaguccccuggucagggaacggggcccacagcgcguggccgcacacaucacggggacuaggggucggagcaauacccucuccaguccgaacagcaaaaaugagaaggcccugggccgcaaaauuaacuccugggaaagcuccaggagugggcauagcuucuuguccaaucugcaccuccggaacggcgagcugguaauccaugagaaggguuuuuacuauauuuacagccagaccuauuuccgcuuucaagaagagaucaaagaaaauacuaagaacgacaagcagauggugcaguacaucuauaaauacaccaguuaucccgauccaauuuugcugaugaaguccgcgaggaauagcugcugguccaaagacgccgaguacgggcucuacaguaucuaucagggcggcauuuucgagcugaaggaaaacgaucggaucuuugucagcgugacgaaugagcaccugauugacauggaucaugaagcauccuucuuuggggccuuccucguggguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 943 - RNA, 1000 nt, Artificial Sequence
  mRNA product Design2 comprising derived and/or modified sequence from Homo sapiens__NP_003801.1__HsALB(1-18)_HsTNFSF10(95-281) (opt7)
ggggcgcugccuacggagguggcagccaucuccuucucggcaucaagcuuaccaugaagugggugaccuucaucagccugcucuuucuguucuccagugccuacagcacuuccgaggaaaccauuaguacgguccaggagaaacaacagaacaucagccccuuggugagggaacggggcccacagcgcguagcagcccacauuacugggaccaggggucgguccaauacccugagcuccccgaacaguaagaaugagaaagcgcucggccgcaagaucaacagcugggaauccagcaggagugggcauuccuuucugagcaauuugcaucugcggaacggcgagcucgugauucacgagaaagguuucuauuacaucuauucccagacuuacuuucgcuuccaagaagagaucaaggaaaauaccaagaacgacaaacagaugguccaguauauuuacaaguauacgaguuaccccgauccaauccugcugaugaaaagcgccaggaacuccugcuggagcaaggacgcagaguacgggcucuauaguauuuaccagggcggcaucuuugagcugaaagaaaaugaucggauuuucguguccgugacuaaugagcacuugaucgacauggaucaugaagccagcuuuuucggggcauuucuggucgguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 944 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt7)
ggggcgcugccuacggagguggcagccaucuccuucucggcaucaagcuuaccaugaagugggugaccuucaucagccugcucuuucuguucuccagugccuacagcaggaugaaacagauugaggacaagaucgaagagauuuuguccaaaaucuaucacauugaaaacgagaucgcacggaucaagaaacugauuggcgaaaccagugaggagacuaucagcacgguccaagaaaagcagcagaauauuaguccccucgugcgcgagagggggccacagcggguagccgcgcauaucacugguacccgcggcaggagcaacacccuguccaguccgaauagcaagaacgaaaaagccuuggggcggaagauuaauuccugggagagcagucgcuccggccacagcuuucuguccaaccuccaucugaggaauggugagcuggugauccacgaaaaaggguucuacuauauuuacagucaaacuuauuuucgguuccaggaggaaaucaaggagaacaccaaaaaugauaagcagaugguccaguacaucuauaaauacacgagcuaccccgacccaauucuccugaugaaguccgcacgcaacagcugcuggaguaaggaugccgaauauggcuuguacuccaucuaucaaggcgggauuuuugagcugaaagagaaugacaggaucuucgugagcgugacuaacgaacaucucauugauauggaccacgaggcauccuuuuucggugccuuucuggucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 945 - RNA, 1459 nt, Artificial Sequence
  mRNA product Design2 comprising derived and/or modified sequence from Rattus norvegicus__NP_036656.1__RnCebpa (opt7)
ggggcgcugccuacggagguggcagccaucuccuucucggcaucaagcuuaccauggagagcgccgacuucuacgaagcagagcccaggccaccgauguccagucaucugcagagcccaccccacgcccccuccaacgcggccuuuggcuucccccgcggggcaggucccgccccaccgcccgcaccacccgccgcgccagaaccccucggcgggaucugcgagcacgaaaccaguauugauaucagcgccuauauugacccggcagccuuuaaugaugaguuccuggccgacuuguuucaacauucccggcagcaggagaaggcaaaagccgcggccggccccgccggugggggcggcgauuucgacuacccaggggcccccgcagguccaggcggggccgugaugagcgccggcgcgcacggucccccaccgggguauggcugugcagccgccggcuaccuggaugggaggcucgaaccccuguaugagcgggucggugcaccagccuugcgcccccuggugaucaagcaggaaccaagggaggaggacgaagcgaaacaacucgcccuggcaggccuguuucccuaccagccgccaccacccccacccccaccgcauccccacgccuccccagcacaccucgccgcaccccaucugcaguuccagauugcacacugcgggcaaacuaccaugcauuugcagccaggccaccccacgccgccacccacuccaguacccaguccgcaccccgccccagcgaugggugccgcaggccugcccgggccaggcgggagccucaagggucuggccggcccccauccagaucugcggaccgggggcgguggcgggggcggggccggcgcagguaaagcgaagaaguccguggacaaaaacagcaaugaguaucgcgucaggcgggaacgcaacaauaucgccgugaggaagagucgggauaaagcaaagcagcgcaacguggagacccagcaaaaagucuuggaacucacuuccgacaaugauaggcugcggaagcgcguggagcagcugagcagggagcucgacacccugcgggggaucuuucgccaguugccggaauccagucugguaaaagccaugggcaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 946 - RNA, 1417 nt, Artificial Sequence
  mRNA product Design2 comprising derived and/or modified sequence from Rattus norvegicus__NP_036656.1__RnCebpa(15-344) (opt7)
ggggcgcugccuacggagguggcagccaucuccuucucggcaucaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacccagcccccgcaaugggugccgcgggccugccggggcccggcgggagucucaagggucuggccggcccacaucccgaccugaggaccgggggcgguggcgggggcggggcaggcgccgguaaagccaaaaagagcguggauaagaacuccaaugaguaccggguccgcagggagcggaacaauaucgcagugcgcaagagcagggacaaagcgaagcagcggaacguggaaacccagcaaaaagucuuggagcucacuuccgauaaugaccgccugaggaagcggguggaacagcugucccgcgagcucgauacccugagggggaucuuccggcaguugccagaaagcucccugguaaaagccaugggcaacugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 947 - RNA, 1462 nt, Artificial Sequence
  mRNA product Design2 comprising derived and/or modified sequence from Mus musculus__NP_031704.2 __MmCebpa (opt7)
ggggcgcugccuacggagguggcagccaucuccuucucggcaucaagcuuaccauggagagcgccgacuucuacgaaguggagcccaggccaccgauguccagucaucugcagagcccaccccacgcacccuccaacgccgcguuuggcuucccccgcggggccggucccgcaccaccgcccgccccacccgcagccccagaaccccucggcgggaucugcgagcacgaaaccaguauugauaucagcgcguauauugacccggccgcauuuaaugaugaguuccuggccgacuuguuucaacauucccggcagcaggagaaggccaaagcagccgcgggccccgccggugggggcggcgauuucgacuacccaggggcacccgccgguccaggcggggcagucaugagcgccggcgcccacggucccccaccgggguauggcugugcggcagccggcuaccuggaugggaggcucgaaccccuguaugagcgggugggugccccagcauugcgcccccugguaaucaagcaggaaccaagggaggaggacgaagccaaacaacucgcgcuggccggccuguuucccuaccagccgccaccacccccacccccaccgcauccccacgcauccccagcccaccucgcagcaccccaucugcaguuccagauugcccacugcgggcaaacuaccaugcauuugcagccaggccaccccacgccgccacccacuccagugcccaguccgcacgccgcccccgcgcugggugccgcaggccucccagggcccggcagcgcccugaaggggcuggccggugcacauccagauuugcggaccggcgggggcgguggcggguccggcgcgggggccggcaaagcaaagaaaagcgucgacaagaacaguaaugaguaucgcgugaggcgggaacgcaacaauaucgccgugaggaagucccgggauaaagccaagcagcgcaacgucgagacccagcaaaaagugcucgaacugacuagcgacaaugauaggcugcggaagcgcguagagcagcucuccagggagcuggacaccuugcgggguaucuuucgccagcugcccgaaaguagccucgugaaagcaauggggaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 948 - RNA, 1420 nt, Artificial Sequence
  mRNA product Design2 comprising derived and/or modified sequence from Mus musculus__NP_031704.2 __MmCebpa(15-359) (opt7)
ggggcgcugccuacggagguggcagccaucuccuucucggcaucaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacgccgcaccagcccugggugcggccggccuccccgggccgggcuccgcacugaaggggcuggccggugcccaucccgacuugaggaccggcgggggcgguggcgggagcggcgcaggggcgggcaaagccaagaaguccguggauaaaaacagcaaugaguaccggguccgcagggagcggaacaauaucgcagugcgcaagaguagggacaaagccaagcagcggaacguggaaacccagcaaaaaguccucgagcugacuuccgauaaugaccgccugaggaagcggguggaacagcucagccgcgagcuggauaccuugagggguaucuuccggcagcugccagaauccagucucguaaaagccauggggaacugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 949 - RNA, 1459 nt, Artificial Sequence
  mRNA product Design2 comprising derived and/or modified sequence from Homo sapiens__NP_004355.2__HsCEBPA (opt7)
ggggcgcugccuacggagguggcagccaucuccuucucggcaucaagcuuaccauggagagcgccgacuucuacgaagcagagcccaggccaccgauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 950 - RNA, 1417 nt, Artificial Sequence
  mRNA product Design2 comprising derived and/or modified sequence from Homo sapiens__NP_004355.2__HsCEBPA(15-358) (opt7)
ggggcgcugccuacggagguggcagccaucuccuucucggcaucaagcuuaccauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 951 - RNA, 1807 nt, Artificial Sequence
  mRNA product Design2 comprising derived and/or modified sequence from Homo sapiens__NP_000448.3__HsHNF4A (opt7)
ggggcgcugccuacggagguggcagccaucuccuucucggcaucaagcuuaccaugaggcugagcaagacccucguggacauggauauggccgacuacuccgcagcccuggaucccgcguauacuaccuuggaguucgaaaacguccaggugcugacgaugggcaaugacacuagcccaagcgaggggaccaaccucaaugccccgaacucccuggguguaagugcauugugcgccaucuguggcgaucgggcaaccgggaaacacuacggcgccagcuccugcgacgguuguaagggguuuuuccgcaggagcgugcggaaaaaucauauguauuccugccgcuuuaguaggcaaugugucguggauaaggacaaacggaaccagugccgcuacuguaggcugaagaagugcuuccgggcgggcaugaaaaaggaagccgugcagaaugagcgcgauaggauuagcacucggcgcuccagcuaugaagacaguucccuccccagcaucaacgcacugcugcaggccgagguccucuccaggcaaauuaccaguccagugagcggcaucaauggggauauucgggccaaaaagaucgcauccaucgccgacguaugugagagcaugaaagaacagcuguuggugcuggucgagugggcgaaguacauucccgccuuuugcgaacucccacuggaugaccagguggcacuguugcgcgcccacgccggugagcaucuccugcugggcgcaacgaaaaggaguaugguguucaaggacguccuccuguuggggaacgauuauaucgugccccggcacugcccagagcuggccgaaaugucccgcguaagcauuaggauccucgacgagcuggugcugccguuucaggaauugcaaauugaugacaaugaguacgcguaccucaaggcaaucauuuucuuugaucccgacgccaaaggccugagugauccagguaagaucaaacggcugaggucccagguccaggugagccucgaagacuauaucaacgaucgccaguacgacagccgggggagguucggcgagcuguugcugcuccugcccacucugcaauccauuaccuggcagaugaucgagcagauucaauuuaucaaguuguucggcauggccaaaauugauaaucuccugcaggaaaugcugcucggggguaguccaagcgacgcaccccaugcccaccacccgcugcauccccacuugaugcaggagcauaugggcacuaacgugaucgucgcgaauaccaugccaacccaccuguccaacgggcagaugugugaauggccccgcccacggggccaagccgcaacgcccgagacuccacagccgagucccccagguggcaguggguccgaacccuauaagcuccugccaggcgccguggcaaccaucguaaagccccugagcgccauuccgcagccaacuaucaccaaacaggaggugauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 952 - RNA, 1012 nt, Artificial Sequence
  mRNA product Design2 comprising derived and/or modified sequence from Homo sapiens__NP_061986.1__HsFGF21 (opt7)
ggggcgcugccuacggagguggcagccaucuccuucucggcaucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 953 - RNA, 1738 nt, Artificial Sequence
  mRNA product Design2 comprising derived and/or modified sequence from Homo sapiens__NP_078852.3__HsOGFRL1 (opt7)
ggggcgcugccuacggagguggcagccaucuccuucucggcaucaagcuuaccaugggcaaccugcucgggggugugagcuucagggagcccaccacugucgaagacugcgauuccaccuggcagacggacagugagccagaaccggaggaacccggcccagggggcgguagcgaggggcccggccaagaguccgaacagccagcccagcccccagagcaggcaggcgggcggccgggugccagucccgcgccagaugaagacgccgaggcagccggcgcagagcaagggggcgauagcacugaagccaccgcgaagcccaaacgcuccuuuuacgccgcaagggaccuguauaaguaccggcaccaguauccaaauuucaaagauauccgcuaccagaacgacuugagcaaucugagguuuuauaagaacaaaauucccuucaagccggaugguguguacaucgaggaaguacucuccaaguggaaaggggacuaugagaagcuggaacauaaucacaccuacauucagugguuguuuccccugcgggagcaaggccucaacuucuacgccaaagagcugacuaccuaugaaaucgaggaauuuaagaaaacgaaggaggccauucgcagguuccugcucgcauacaaaaugaugcuggaauuuuucggcaucaaguugacugauaagaccgggaauguggcccgggcggucaacuggcaggagcgcuuucagcaucugaaugagagucagcacaacuaucucaggaucacucggauucugaaaagccugggugaauugggcuacgaguccuucaagagcccacucgugaaauucauccugcaugaagcccugguggagaauaccauucccaacaucaagcaaagugcacucgaauauuuugucuacaccauucgcgacaggcgggagcgcaggaaacuguugcgguucgcccagaagcacuauacgccauccgagaauuuuaucugggggcccccacgcaaggaacagagcgagggcuccaaagcacaaaagaugaguagcccgcuggccuccagccacaacagucagacuuccaugcauaaaaaggccaaagauagcaagaauaguuccagcgcggugcaccucaacagcaagaccgcagaagacaaaaagguagcccccaaagagccaguggaggaaacugacaggcccuccccagagcccaguaacgaagccgcaaagccgcggaauaccgagaaagauagcaacgccgaaaauaugaacucccagccagagaagaccgucacuacgcccaccgagaagaaagaaagcgugagucccgagaauaacgaagaggguggcaaugacaaccaggauaaugaaaacccagggaauacuaacugucaugacgugguccuggugcaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 954 - RNA, 940 nt, Artificial Sequence
  mRNA product Design2 comprising derived and/or modified sequence from Homo sapiens__NP_008842.1__HsRLN1 (opt7)
ggggcgcugccuacggagguggcagccaucuccuucucggcaucaagcuuaccaugcccaggcuguuccucuuucaccuguuggaguucugccugcuccugaaccaguuuagccgggccguggcagccaaguggaaagacgaugucaucaaguuguguggccgcgaacuggugagggcgcaaauugccaucugcgggauguccaccuggaguaaacggagccucucccaggaggacgcaccacagacuccgcgccccguagccgaaauugugccaaguuucaucaauaaggauaccgagacgauuaucaucaugcuggaauuuauugcaaaccugcccccagagcucaaagccgcgcugagcgagaggcagcccuccuugccagaacugcaacaguacgucccggcccucaaggacagcaaucuguccuucgaggaauuuaagaaacugauccggaaccgccagagugaggcagccgauagcaaucccuccgaguugaaguaucucggucuggacacucauagccagaaaaagaggcggccauacguggcccuguucgaaaaauguugccucauuggcuguaccaagcgcagucuggcaaaauauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 955 - RNA, 940 nt, Artificial Sequence
  mRNA product Design2 comprising derived and/or modified sequence from Homo sapiens__NP_604390.1__HsRLN2 (opt7)
ggggcgcugccuacggagguggcagccaucuccuucucggcaucaagcuuaccaugcccaggcuguucuuuuuccaccuccugggcgugugcuugcugcucaaccaguuuagccgggccgucgcagacuccuggauggaggaagugaucaagcugugugggcgcgaguugguaagggcccaaauugcgaucugcgguaugaguaccuggagcaaacggucccugagucaggaagaugccccacagacuccgcgccccguggcagagauuguccccagcuucaucaauaaggacaccgaaacgauuaacaugauguccgaguuuguggccaaucucccacaggagcugaaacugacucucagcgaaaugcaaccagcacugccccaguugcagcagcaugugccaguccugaaggauuccagucuccuguucgaggaauuuaaaaagcugaucaggaaccggcaaagcgaggccgcggacuccagcccgagugaguugaaguaccucggccuggauacccacucccgcaaaaagaggcagcuguauagcgcccucgcaaauaaauguugccaugugggguguaccaagcggucccuggcccgcuucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 956 - RNA, 811 nt, Artificial Sequence
  mRNA product Design2 comprising derived and/or modified sequence from Homo sapiens__NP_543140.1__HsRLN3  (opt7)
ggggcgcugccuacggagguggcagccaucuccuucucggcaucaagcuuaccauggccagguacaugcugcuccuguugcuggcaguguggguccucaccggcgagcuguggcccggggccgaagcgcgggccgcaccauauggugugcgcuugugcggcagggaguucauccgggccguaauuuuuacuugugggggcagccgcuggaggcgguccgacauccuggcacacgaagccaugggugauaccuucccggacgcggaugccgacgaggauagucucgcaggggaacuggacgaggccaugggcagcuccgaguggcuggcccucacgaagaguccccaggcauuuuaccgcggcaggccaagcuggcaagggacucccggugugcugcggggcucccgcgaugucuuggccgggcugagcuccaguugcuguaaauggggcugcagcaaguccgaaauuagcagucucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 957 - RNA, 1792 nt, Artificial Sequence
  mRNA product Design2 comprising derived and/or modified sequence from Homo sapiens__NP_002412.1__HsMMP1 (opt7)
ggggcgcugccuacggagguggcagccaucuccuucucggcaucaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 958 - RNA, 1552 nt, Artificial Sequence
  mRNA product Design2 comprising derived and/or modified sequence from Homo sapiens__NP_002412.1__HsMMP1(1-19,100-469) (opt7)
ggggcgcugccuacggagguggcagccaucuccuucucggcaucaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 959 - RNA, 3739 nt, Artificial Sequence
  mRNA product Design2 comprising derived and/or modified sequence from Clostridium histolyticum__BAA77453.1__ColG (opt7)
ggggcgcugccuacggagguggcagccaucuccuucucggcaucaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 960 - RNA, 3463 nt, Artificial Sequence
  mRNA product Design2 comprising derived and/or modified sequence from Clostridium histolyticum__BAA77453.1__HsALB(1-18)_ColG(111-1118) (opt7)
ggggcgcugccuacggagguggcagccaucuccuucucggcaucaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 961 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt7)
ggggcgcugccuacggagguggcagccaucuccuucucggcaucaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 962 - RNA, 3487 nt, Artificial Sequence
  mRNA product Design2 comprising derived and/or modified sequence from Clostridium histolyticum__BAA34542.1__ColH (opt7)
ggggcgcugccuacggagguggcagccaucuccuucucggcaucaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 963 - RNA, 3448 nt, Artificial Sequence
  mRNA product Design2 comprising derived and/or modified sequence from Clostridium histolyticum__BAA34542.1__ColH (opt7)
ggggcgcugccuacggagguggcagccaucuccuucucggcaucaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 964 - RNA, 3382 nt, Artificial Sequence
  mRNA product Design2 comprising derived and/or modified sequence from Clostridium histolyticum__BAA34542.1__HsALB(1-18)_ColH(41-1021) (opt7)
ggggcgcugccuacggagguggcagccaucuccuucucggcaucaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 965 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt7)
ggggcgcugccuacggagguggcagccaucuccuucucggcaucaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 966 - RNA, 1228 nt, Artificial Sequence
  mRNA product Design2 comprising derived and/or modified sequence from Homo sapiens__NP_003801.1__HsTNFSF10 (opt8)
ggggcgcugccuacggagguggcagccaucuccuucucggcaucaagcuuaccauggccaugauggaaguacaaggaggccccucacucggccaaaccugcguccucaucguaaucuucaccguccuccuccaaucccucugcgucgcgguaacauacgucuacuucacaaacgaacucaaacaaaugcaagacaaauacuccaaauccggaaucgccugcuuucuaaaagaagacgacuccuacugggaccccaacgacgaagaaagcaugaacucccccuguuggcaagucaaauggcaacuccgccagcucguccgaaaaaugauacuacgcaccuccgaagaaacuaucuccaccguccaagagaaacaacaaaacaucuccccacugguccgagaacgaggcccccaacgcguagccgcccacaucacuggcacacgaggacgcuccaacacccuaucaucccccaacuccaaaaacgaaaaagcccuaggccgcaaaaucaacucaugggagucaucccgauccggccacuccuuccucuccaaccuacaccuacgcaacggagaacucgucauacacgaaaaaggauucuacuacauauauucccaaaccuacuuccgcuuccaagaggaaauaaaagaaaacaccaaaaacgacaaacaaaugguccaauacauauacaaauacacauccuaccccgaccccauacuccucaugaaauccgcccgcaacucuugcugguccaaggacgcagaauacggacucuacucaaucuaccaaggcggaauauucgaacucaaagaaaacgaccgcaucuucguaucaguaaccaacgagcaccucaucgacauggaccacgaagccuccuucuucggcgccuuccucguaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 967 - RNA, 949 nt, Artificial Sequence
  mRNA product Design2 comprising derived and/or modified sequence from Homo sapiens__NP_003801.1__HsTNFSF10(95-281) (opt8)
ggggcgcugccuacggagguggcagccaucuccuucucggcaucaagcuuaccaugacaucagaagaaaccaucuccacaguccaagaaaaacaacaaaacaucucaccccuaguacgcgaacgcggcccacaacgcguagccgcacacaucaccggcacccgcggaagauccaacacccucuccucccccaacuccaaaaacgaaaaagcccucggccgaaaaaucaacuccugggaauccagccgaucaggccacucauuccucucaaaccuacaccuccgaaacggcgaacucguaauccacgaaaaaggcuucuacuacaucuacucccaaaccuacuuccgcuuccaagaagaaauaaaagaaaacaccaaaaacgacaaacaaaugguccaauacaucuacaaauacaccuccuacccagaccccauccuacuaaugaaauccgcacgaaacuccugcuggucaaaagacgccgaauacggacucuacuccaucuaccaaggcggaaucuucgaacucaaagaaaacgaccgcaucuucgucagcguaaccaacgaacaccucaucgacauggaccacgaagccagcuucuucggagccuuccuagucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 968 - RNA, 1000 nt, Artificial Sequence
  mRNA product Design2 comprising derived and/or modified sequence from Homo sapiens__NP_003801.1__HsALB(1-18)_HsTNFSF10(95-281) (opt8)
ggggcgcugccuacggagguggcagccaucuccuucucggcaucaagcuuaccaugaaaugggucaccuucaucucccuccuauuccuauucucaucagcauacuccaccagcgaagaaaccaucuccaccguccaagaaaaacaacaaaacaucuccccacucguccgcgaacgcggcccacaacgcgucgccgcccacaucaccggaacccgcggacgauccaacacacuauccucacccaacuccaaaaacgaaaaagcccucggacgcaaaauaaacucaugggaaucaucacgcucaggacacucauuccuguccaaccuccaccuacgaaacggcgaacucgucauccacgaaaaaggauucuacuacauauacucacaaaccuacuuccgcuuccaagaagaaaucaaagaaaacaccaaaaacgacaaacaaaugguccaauacaucuacaaauacaccuccuaccccgaccccauacuacucaugaaaucagcacgaaacuccugcugguccaaggacgccgaauacggccucuacuccauauaccaaggcggcaucuucgaacucaaagaaaacgaccguaucuucguaucaguaaccaacgaacaccucaucgacauggaccacgaagccuccuucuucggagccuuccuagucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 969 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt8)
ggggcgcugccuacggagguggcagccaucuccuucucggcaucaagcuuaccaugaaaugggugaccuucaucucacuccuauuccuguucucgagcgcauacucgcgcaugaaacaaaucgaggacaaaaucgaagaaauacucucgaaaaucuaccacaucgagaacgaaaucgcacgcaucaaaaagcucauaggcgaaaccucggaagaaaccauaagcacgguccaagaaaagcaacaaaacauaagcccacucguacgcgagcgcggaccccagcgcguggccgcacacauaaccgggaccaggggaagauccaacacccugagcucgcccaacagcaaaaacgaaaaagcgcucgggcgaaaaaucaacagcugggaauccuccaggagcgggcacucguuccuaagcaaccuccaccucagaaacggggaauuagucauacacgagaaaggguucuacuacauauacucacaaacauacuuccgcuuccaagaagaaauaaaagagaacacgaaaaaugacaaacaaaugguccaguauauauacaaauacacaagcuauccagauccaauacuccugaugaaaagcgcgcgcaacagcuguuggucaaaagaugccgaguacggccuauacuccauauaccagggcggaaucuucgaacucaaagaaaacgaucgcaucuucgugagcguaacaaacgaacaccucauagacauggaccacgaagcgagcuucuucggagccuuccucgugggauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 970 - RNA, 1459 nt, Artificial Sequence
  mRNA product Design2 comprising derived and/or modified sequence from Rattus norvegicus__NP_036656.1__RnCebpa (opt8)
ggggcgcugccuacggagguggcagccaucuccuucucggcaucaagcuuaccauggaaagcgcagacuucuacgaagcagaaccccgcccccccauguccucccaccuccaaucccccccccacgccccuuccaaugcagcauucggcuucccccgcggagcaggacccgcacccccaccagccccccccgccgcccccgaaccccucggcggaauaugcgaacacgaaacauccaucgacauauccgcuuacauugaccccgccgccuucaacgacgaauuccucgcagaccucuuucaacacagccgccaacaggaaaaagcaaaagccgcagccggccccgccggcggcggaggcgacuucgacuaccccggcgccccagccggaccaggaggcgccgucauguccgcaggcgcccacggccccccccccggcuacggcugcgcugccgccggcuaccucgacggccgccucgaaccccucuacgaacgagucggagccccagcacuccgaccacucguaaucaaacaagaaccccgcgaagaagacgaagcgaaacaacuugcacucgcaggccuauuccccuaccaaccccccccaccccccccacccccccacccccacgcauccccagcccaccucgccgcaccccaccuccaauuccaaauagcccauugcggccaaaccaccaugcaccuccaaccaggccaccccaccccaccccccacacccguaccaucgccucacccagcccccgcaaugggcgccgccggccuaccuggcccaggcggcagccucaaaggacuugcaggcccacaccccgaccucagaacaggcggcggcggcggcggaggcgccggcgccggcaaagcaaaaaaaucagucgacaaaaacuccaacgaauaccgaguccgacgcgaacgcaacaacaucgccguccgcaaaucccgcgacaaagccaaacaaagaaacguagaaacacaacaaaaaguucucgaacuuacaucagacaaugacagacuucgcaaacgcgucgagcaacuaucccgcgaacucgacacccuccgagguaucuuccgacaacuccccgaauccucccucgucaaagccaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 971 - RNA, 1417 nt, Artificial Sequence
  mRNA product Design2 comprising derived and/or modified sequence from Rattus norvegicus__NP_036656.1__RnCebpa(15-344) (opt8)
ggggcgcugccuacggagguggcagccaucuccuucucggcaucaagcuuaccauguccucccaccuccaaucccccccacacgcaccauccaacgccgccuucggcuuccccagaggcgccggccccgcccccccccccgccccccccgccgcccccgaaccccuaggcggcauaugcgaacacgaaaccuccaucgacaucucagccuacauagaccccgccgcauucaacgacgaauuccucgccgaccuuuuccaacacagccgucaacaagaaaaagccaaagccgccgccggaccagccggcggcggcggcgacuucgacuacccaggcgcccccgccggacccggcggcgccgucaugucagcaggagcccacggcccaccucccggcuacggaugcgccgcagcaggcuaccucgacggcagacuagaaccacuauacgaacgcgugggagcacccgcacuccgaccccucguaaucaaacaagaaccaagagaagaagacgaagccaaacaacucgcacucgccggccucuuccccuaccaaccacccccaccccccccacccccccacccccacgcauccccagcacaccuagccgccccccaccuucaauuccaaaucgcacacugcggccagacaacaaugcaccuccaacccggccaccccacacccccucccacccccgucccauccccccacccagcccccgcaaugggcgccgccggacuaccaggacccggcggaucccuaaaaggacucgccggcccccaccccgacuuacgcaccggcggcggcggcggcggaggcgccggggcaggcaaagccaaaaaauccgucgacaaaaacucaaacgaauacagaguacgccgagaacgaaauaacaucgccguccgaaagucacgcgacaaagcaaaacaacgaaacgucgaaacacaacaaaaaguacuagaacucaccuccgacaacgaccgacuacgaaaacgcgucgaacaacuuucacgcgaacucgacacccuccgcggaaucuuccgacaacuaccagaaucaucccuugucaaagccaugggaaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 972 - RNA, 1462 nt, Artificial Sequence
  mRNA product Design2 comprising derived and/or modified sequence from Mus musculus__NP_031704.2 __MmCebpa (opt8)
ggggcgcugccuacggagguggcagccaucuccuucucggcaucaagcuuaccauggaauccgccgacuuuuacgaaguagaaccccgcccacccauguccucccaucugcaaucaccuccccacgcccccuccaacgccgcauucggauucccccgcggcgcaggacccgccccacccccagccccacccgcagcccccgaaccccucggcggcauuugcgaacacgaaaccuccaucgacaucucagccuacauagaccccgccgccuucaacgacgaguuccucgccgaccuuuuccaacacucccgccaacaagaaaaagccaaagcagccgccggccccgccggaggcggcggagacuucgacuaccccggcgcacccgccggacccggaggcgccgucaugucagcaggcgcccauggacccccacccggcuacggaugugcagccgccggauacuuagacggccgccuagaaccccucuacgaacgcguaggcgcccccgcccuucgcccccucguuaucaaacaagaaccccgcgaagaagacgaagccaaacaacuagcccuagccggccucuuccccuaccaacccccacccccacccccgccaccccacccccaugcaucccccgcccaccuagccgcuccccaccuacaauuccaaaucgcacacugcggccaaacaaccaugcacuuacaacccggccaccccacacccccacccacccccgucccgucaccccacgccgccccagcccuaggagccgccggccuccccggacccggcuccgcccuaaaaggacucgccggcgcccacccagaccuccgaacaggcggcggcgguggcggcuccggcgccggggcaggaaaagccaagaaauccguagacaaaaacuccaacgaauaccgcguccgacgcgaaagaaacaacaucgccguccgaaaaucccgcgacaaagcaaaacaaagaaacgucgaaacacaacaaaaaguccuagaacuaaccuccgacaacgaccgccuucguaaacgcguagaacaacuaucccgcgaacucgacacccuacgcggcaucuuccgccaacuccccgaaucaucccucguuaaagcaaugggcaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 973 - RNA, 1420 nt, Artificial Sequence
  mRNA product Design2 comprising derived and/or modified sequence from Mus musculus__NP_031704.2 __MmCebpa(15-359) (opt8)
ggggcgcugccuacggagguggcagccaucuccuucucggcaucaagcuuaccaugucaagccaccuccaaucacccccccacgcccccucuaacgccgcauucgguuucccccgaggcgccgguccagccccacccccugcgcccccagccgccccagaaccccuuggaggaaucugcgaacacgaaaccuccauagacauaucagccuacaucgaccccgccgccuucaacgaugaauuccuagccgaccucuuccaacacucacgccaacaagaaaaagcaaaagccgccgccggcccagccggcggcggaggagacuucgacuacccaggcgcacccgcaggaccgggaggagccguaauguccgcaggcgcccacggcccaccccccggauacggaugcgcagccgccggcuaccucgacggacgacuagaaccacucuacgaaagagucggcgcccccgcccuacgcccccucguaauaaaacaagaaccccgagaagaagacgaagccaaacaacucgcccucgccggacucuuccccuaccaaccgccccccccccccccccccccacacccacacgcaucaccagcccaccuagcagccccccaccuacaauuccaaauagcccacugcggacaaaccaccaugcaccuacaaccaggccaccccaccccaccucccaccccagucccauccccacacgccgccccagcccucggcgccgccggacucccaggacccggcucagcccucaagggacuagccggagcacaccccgaccuccgaacaggcggaggaggcggcggcuccggagcuggugccggaaaagcaaaaaaauccgucgacaaaaacuccaacgaauacagaguccgccgagaacgaaacaacauagccguccgaaaaucccgagacaaagcaaaacaacgaaacgucgaaacccaacaaaaaguccuagaacuaaccucugacaacgaccgacuacgcaaacgagucgaacaacucagcagagaacucgacacccucagaggaauauuccgacaacuaccagaauccucccuagucaaagcuaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 974 - RNA, 1459 nt, Artificial Sequence
  mRNA product Design2 comprising derived and/or modified sequence from Homo sapiens__NP_004355.2__HsCEBPA (opt8)
ggggcgcugccuacggagguggcagccaucuccuucucggcaucaagcuuaccauggaauccgccgacuucuacgaagccgaaccacgaccccccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 975 - RNA, 1417 nt, Artificial Sequence
  mRNA product Design2 comprising derived and/or modified sequence from Homo sapiens__NP_004355.2__HsCEBPA(15-358) (opt8)
ggggcgcugccuacggagguggcagccaucuccuucucggcaucaagcuuaccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 976 - RNA, 1807 nt, Artificial Sequence
  mRNA product Design2 comprising derived and/or modified sequence from Homo sapiens__NP_000448.3__HsHNF4A (opt8)
ggggcgcugccuacggagguggcagccaucuccuucucggcaucaagcuuaccaugcgccuauccaaaacacucguagacauggauauggcagacuacuccgccgcccucgaccccgccuacacaacucuagaguucgaaaacguccaaguccucaccaugggcaacgauaccuccccauccgaaggaaccaaccucaacgccccaaacucccucggcgucucagcccuaugcgccaucugcggagaccgcgccaccgggaaacacuacggcgccucguccugugacgggugcaaagguuucuuccgccgcuccguccgcaaaaaucacauguacuccugccgauucucccgacaaugcgucguagacaaagauaaaagaaaccagugccgcuacugccgccugaagaaaugcuuccgcgcaggaaugaagaaagaagccguccaaaacgaacgcgaccgcaucucaacccgacgcuccucauaugaagacuccagccuccccucaaucaacgcacuacuacaagccgaaguccucagccgccaaauaacaucaccugucucuggcaucaacggagacaucagagcaaagaaaauugcaucaaucgcagacgucugcgaaucuaugaaagaacaacuccucguccugguugaaugggccaaauacaucccagccuucugcgaacucccccucgacgaccaagucgcacuacuccgcgcacacgccggcgaacaccuccuacucggcgccacaaaacgcuccauggucuucaaagacguccuccuccuaggcaacgacuacaucguccccagacacugccccgaacucgccgaaaugagccgagucucaauccggauacuagacgaacucguacucccauuccaagagcuucaaauagacgacaaugaauacgccuaccuuaaagcaauaauauucuucgauccagacgcuaaaggacucucugaccccggcaaaaucaaacgcuuacgaucccaaguccaagucucacuagaagacuacaucaacgaccgacaauacgacucccgcggcagauucggggaacuccuccuccuccuacccacacuccaaagcaucaccuggcaaaugaucgaacaaauccaauucauaaaacucuucggaauggccaaaaucgacaaccuccuacaagaaaugcuacucggcggcucccccuccgacgcaccccacgcccaucacccccuccacccacaccucaugcaagaacacaugggcaccaacguaauagucgccaacaccaugccaacccaccuaucaaacggucaaaugugcgaauggccuagaccccguggccaagccgccacgcccgaaacaccacagcccuccccacccggcggcuccggcucagaacccuacaaacuacuacccggagccgucgccacaaucguaaaaccccuaucggccaucccccaacccaccaucaccaaacaagaagucaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 977 - RNA, 1012 nt, Artificial Sequence
  mRNA product Design2 comprising derived and/or modified sequence from Homo sapiens__NP_061986.1__HsFGF21 (opt8)
ggggcgcugccuacggagguggcagccaucuccuucucggcaucaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 978 - RNA, 1738 nt, Artificial Sequence
  mRNA product Design2 comprising derived and/or modified sequence from Homo sapiens__NP_078852.3__HsOGFRL1 (opt8)
ggggcgcugccuacggagguggcagccaucuccuucucggcaucaagcuuaccaugggcaaccuacucggcggcgucucguuccgcgaaccaaccaccguagaggacugcgacagcaccuggcaaaccgacuccgaaccugaacccgaagaacccggccccggcggcggcagcgaaggccccggccaagaaucggaacaacccgcccaacccccagaacaagccggcggacgacccggcgccucacccgccccagacgaagacgcagaagccgccggggccgagcaaggcggcgacucuaccgaagccacagcuaaaccaaaacggagcuucuacgccgcccgcgaccucuacaaauaccgccaccaauaccccaacuucaaagacauccgcuaccaaaacgaccuauccaaucuucgcuuuuauaaaaacaaaauaccuuucaaacccgacggcgucuacaucgaagaaguucuaagcaaauggaaaggcgacuacgaaaaacucgaacacaaccacaccuacauccaauggcuauucccgcuacgcgaacaaggccugaacuucuaugccaaagaacuaaccaccuacgaaauagaagaguucaaaaaaaccaaagaagcaauacgccgcuuccuccuagccuacaaaaugaugcucgaauuuuucgggaucaaacuaaccgacaaaaccggcaacgucgcccgcgcuguaaauuggcaagaacgauuccaacaccuaaacgagucccagcacaacuaccuaagaaucacccgaauacucaaaucccucggagagcucggcuacgaauccuucaaauccccacucgucaaguucauccuccacgaggcccucgucgagaacaccauccccaacaucaaacaguccgcacuagaauacuucguguacaccauccgcgaccgccgugaacgacgcaaacuccuacgcuucgcccaaaaacacuacacacccuccgaaaacuucaucuggggcccacccagaaaagaacaauccgaaggauccaaagcccaaaaaauguccagcccacuagccagcucccauaacucacaaacaucaaugcacaaaaaggccaaagacucaaaaaacuccuccagcgccguacaccucaacuccaaaaccgccgaagacaaaaaagucgcccccaaggaacccgucgaagaaacagaccgcccaucgccagaacccucaaacgaagccgcaaaaccccgcaacaccgagaaagacucaaaugccgaaaauaugaacucgcaacccgagaaaacagucaccacccccacagaaaaaaaagaauccgugagcccagaaaacaacgaagaaggcggcaacgacaaccaagacaacgaaaacccuggaaacaccaacugccacgacgucguacucguacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 979 - RNA, 940 nt, Artificial Sequence
  mRNA product Design2 comprising derived and/or modified sequence from Homo sapiens__NP_008842.1__HsRLN1 (opt8)
ggggcgcugccuacggagguggcagccaucuccuucucggcaucaagcuuaccaugccccgccucuuccucuuccaccuccuagaauuuugccuccuccucaaccaauucucccgcgccgucgccgccaaauggaaagacgacguuauaaaacucugcggccgcgaacucguccgcgcccaaaucgccaucugcggcaugucaaccugguccaaacgcucacucucacaagaagacgccccccaaaccccccgcccagucgccgaaaucgucccaucauucaucaacaaagacacagaaaccauaaucaucaugcucgaauuuauagccaaccucccccccgaacucaaagccgcccucuccgaacgacaacccucccuccccgaacuacaacaauacgucccagcccucaaagacucaaaccucucauuugaagaauuuaaaaaacuaauccgcaaccgacaauccgaagccgccgacuccaaccccuccgaacuaaaauaccucggccuugacacccacagccaaaaaaaacgcagacccuacgucgcacucuucgaaaaaugcugccucaucggaugcaccaaacgcucccucgccaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 980 - RNA, 940 nt, Artificial Sequence
  mRNA product Design2 comprising derived and/or modified sequence from Homo sapiens__NP_604390.1__HsRLN2 (opt8)
ggggcgcugccuacggagguggcagccaucuccuucucggcaucaagcuuaccaugccccgccucuucuucuuccaccuccucggcguaugccuccuccucaaccaauucucccgcgccgucgccgacuccuggauggaagaagucaucaaacucugcggacgcgaacucguccgcgcccaaaucgccauaugcggcauguccacuugguccaaacgcucccucucccaagaggacgcaccacaaaccccccgacccgucgcagaaaucgucccauccuucaucaacaaagacaccgaaacuaucaacaugaugucagaauuugucgcaaaccucccccaagaacuuaaacucacccucuccgaaaugcaacccgcccucccccaacuacaacaacacguccccguacuaaaagacuccucccuccucuuugaagaauuuaaaaaacuaauccgcaaccgccaaucagaagccgccgacagcucccccucagaacucaaauaccucggacucgacacacacucccgcaaaaaacgccaacuauacucagcacucgccaacaaaugcugccacgucggcugcaccaaacgcucacucgcccgauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 981 - RNA, 811 nt, Artificial Sequence
  mRNA product Design2 comprising derived and/or modified sequence from Homo sapiens__NP_543140.1__HsRLN3  (opt8)
ggggcgcugccuacggagguggcagccaucuccuucucggcaucaagcuuaccauggcgagauauauguugcuacugcucuuggccgugugggugcucacgggagagcucuggcccggggccgaggccagggccgcgcccuauggagugcgauugugcgggcgcgaguucauacgcgcgguaauauucacgugcgggggaucgcgcuggcgcaggagcgauaucuuggcccaugaagcgaugggggacacauucccggacgcagacgcggacgaggacucgcucgcgggcgagcucgaugaagcgauggggaguucggaauggcuagcgcuaacgaaaucgccccaggccuuuuacaggggcaggccaucauggcagggaacgcccgggguccugcgagggagcagggacguguuagcgggcuugagcucaagcuguugcaagugggggugcucgaaaucagaaauaagcucgcucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 982 - RNA, 1792 nt, Artificial Sequence
  mRNA product Design2 comprising derived and/or modified sequence from Homo sapiens__NP_002412.1__HsMMP1 (opt8)
ggggcgcugccuacggagguggcagccaucuccuucucggcaucaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 983 - RNA, 1552 nt, Artificial Sequence
  mRNA product Design2 comprising derived and/or modified sequence from Homo sapiens__NP_002412.1__HsMMP1(1-19,100-469) (opt8)
ggggcgcugccuacggagguggcagccaucuccuucucggcaucaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 984 - RNA, 3739 nt, Artificial Sequence
  mRNA product Design2 comprising derived and/or modified sequence from Clostridium histolyticum__BAA77453.1__ColG (opt8)
ggggcgcugccuacggagguggcagccaucuccuucucggcaucaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 985 - RNA, 3463 nt, Artificial Sequence
  mRNA product Design2 comprising derived and/or modified sequence from Clostridium histolyticum__BAA77453.1__HsALB(1-18)_ColG(111-1118) (opt8)
ggggcgcugccuacggagguggcagccaucuccuucucggcaucaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 986 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt8)
ggggcgcugccuacggagguggcagccaucuccuucucggcaucaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 987 - RNA, 3487 nt, Artificial Sequence
  mRNA product Design2 comprising derived and/or modified sequence from Clostridium histolyticum__BAA34542.1__ColH (opt8)
ggggcgcugccuacggagguggcagccaucuccuucucggcaucaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 988 - RNA, 3448 nt, Artificial Sequence
  mRNA product Design2 comprising derived and/or modified sequence from Clostridium histolyticum__BAA34542.1__ColH (opt8)
ggggcgcugccuacggagguggcagccaucuccuucucggcaucaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 989 - RNA, 3382 nt, Artificial Sequence
  mRNA product Design2 comprising derived and/or modified sequence from Clostridium histolyticum__BAA34542.1__HsALB(1-18)_ColH(41-1021) (opt8)
ggggcgcugccuacggagguggcagccaucuccuucucggcaucaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 990 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt8)
ggggcgcugccuacggagguggcagccaucuccuucucggcaucaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 991 - RNA, 1228 nt, Artificial Sequence
  mRNA product Design2 comprising derived and/or modified sequence from Homo sapiens__NP_003801.1__HsTNFSF10 (opt9)
ggggcgcugccuacggagguggcagccaucuccuucucggcaucaagcuuaccauggccaugauggaaguccaaggcggaccaucccucggccaaaccugcguccuaaucgucaucuucaccguccuccuccaaucacucugcguagccgucaccuacguauacuucacaaacgaacuaaaacaaaugcaggacaaauacuccaaauccggcaucgccugcuuccucaaagaagacgacuccuacugggacccaaacgacgaagaauccaugaacuccccaugcuggcaagucaaauggcaacuccgccaacucguccgcaaaaugauccuccgcaccagcgaagaaaccaucagcacaguacaagaaaaacaacaaaacaucagcccccucguacgcgagagaggaccccaacgcguagcagcccacaucacaggcaccagaggccgcuccaacacccucuccucccccaacuccaaaaacgaaaaagcccucggccgcaaaaucaacuccugggaaagcucccgcucaggccacucauucuuauccaaccuacaccuccgcaacggagaacucguaauccacgaaaaaggcuucuacuacaucuacucccaaaccuacuuccgcuuccaagaagaaaucaaagaaaacacuaaaaacgacaaacagaugguccaauacaucuacaaauacaccuccuaccccgaccccauacuccucaugaaaagcgccagaaacuccugcuggagcaaagacgccgaauacggccuauacuccaucuaccaaggcggcaucuucgaacucaaagaaaacgaccgaaucuucgucuccguaaccaacgaacaccuaaucgacauggaccacgaagccuccuucuucggagcuuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 992 - RNA, 949 nt, Artificial Sequence
  mRNA product Design2 comprising derived and/or modified sequence from Homo sapiens__NP_003801.1__HsTNFSF10(95-281) (opt9)
ggggcgcugccuacggagguggcagccaucuccuucucggcaucaagcuuaccaugaccucagaagaaaccaucuccacaguccaagaaaaacaacaaaacauaagcccccucguccgcgaacgcggaccccaacgcguagccgcacacaucaccggaacccgcggccgauccaacacccucuccucacccaacuccaaaaacgaaaaagcccucggccgcaaaaucaacuccugggaaucaucccgcuccggccacuccuuccuaucaaaccuccaccuacgaaacggcgaacucgucauccacgaaaaaggcuucuacuacaucuacucccaaacauacuuccgauuccaagaagaaaucaaagaaaacaccaaaaacgacaaacaaaugguccaauacaucuacaaauacacauccuaccccgacccaauacuacucaugaaaagcgcccgcaacuccugcuggucaaaagacgccgaauacggacucuacuccaucuaccaaggcggcaucuucgaacugaaagaaaacgaccgcauauucguauccgucaccaacgaacaccucaucgacauggaccacgaagccagcuucuucggcgccuuucucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 993 - RNA, 1000 nt, Artificial Sequence
  mRNA product Design2 comprising derived and/or modified sequence from Homo sapiens__NP_003801.1__HsALB(1-18)_HsTNFSF10(95-281) (opt9)
ggggcgcugccuacggagguggcagccaucuccuucucggcaucaagcuuaccaugaaauggguaacauucaucucccuccuauuccuauucuccuccgccuacuccaccuccgaagaaaccauauccacaguccaagaaaaacaacaaaacauaucaccccucguacgagaacgaggcccccaacgcgucgccgcacacaucaccggcacccgcggccgcuccaacacccucuccucacccaacuccaaaaacgaaaaagcccucggccgcaaaaucaacuccugggaauccucacgauccggccacuccuuccucucaaaccuccaccuccgcaacggcgaacucgucauccacgaaaaaggcuucuacuacaucuacucacaaacauacuuucgcuuccaagaagaaaucaaagaaaacaccaaaaacgacaaacaaaugguccaauacaucuacaaauacaccucuuaccccgacccaauccuccucaugaaaucagcccgcaacuccugcugguccaaagacgccgaauacggccucuacuccauauaccaaggcggcauauucgaacuaaaagaaaacgaccgaauauucgucuccguaaccaacgaacaccucaucgacauggaccacgaagccucauucuucggagccuuucucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 994 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt9)
ggggcgcugccuacggagguggcagccaucuccuucucggcaucaagcuuaccaugaaauggguaaccuucaucucccuccucuuccucuuuuccuccgccuacucccgcaugaaacaaauagaagacaaaaucgaagaaauccucuccaaaaucuaccacaucgaaaacgaaauagcacgaaucaagaaacuaauaggagaaaccuccgaagaaaccauauccaccguccaggaaaaacaacaaaacauaagcccccucguccgcgaacgcggaccccaacgcgucgccgcccacaucaccgggacccgaggccgauccaacacccugagcucacccaacagcaaaaacgaaaaagcacuaggccgcaaaaucaacuccugggaauccuccagauccggccacuccuuccuaagcaaccuccaccucagaaacggcgaacucguaauccacgaaaaaggcuucuacuacaucuacucacaaaccuacuuccgcuuccaagaagaaaucaaagaaaacaccaaaaacgacaaacaaaugguccaauacaucuacaaauacacaagcuaccccgacccaauccuccuaaugaaaagcgcccgcaacuccugcuggucaaaagacgccgaauacggacucuacuccauauaccaaggcggcaucuucgaacucaaagaaaacgaccgcaucuucgucuccgucacaaacgaacaccucauagacauggaccacgaagccuccuucuucggagccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 995 - RNA, 1459 nt, Artificial Sequence
  mRNA product Design2 comprising derived and/or modified sequence from Rattus norvegicus__NP_036656.1__RnCebpa (opt9)
ggggcgcugccuacggagguggcagccaucuccuucucggcaucaagcuuaccauggaauccgccgacuucuacgaagccgaaccccgacccccaaugucaagucaucuccaaagcccaccccacgcacccuccaacgccgccuucggauuccccagaggcgccggacccgcacccccaccagcaccacccgcagcacccgaaccccuaggagguaucugcgaacacgaaaccucaauagacaucuccgcauacauagacccagcagccuucaacgacgaguuccuagccgaccuauuccaacacagccgacaacaagaaaaagccaaagccgcagcaggacccgcaggaggaggcggagacuucgacuacccaggcgcaccagccggaccaggaggagcaguaauguccgccggagcccacggcccaccacccggcuacgggugcgcagccgcgggcuaucuugacggccgccucgaaccccucuacgaacgaguaggcgcacccgcccucagaccccucgucauaaaacaagaaccccgugaagaagacgaagcaaaacaacucgcccucgcaggccuauuccccuaccaacccccaccuccaccacccccaccccacccccacgcaagccccgcacaccuugcagcgccccaccuccaauuccaaauagcccacugcggacaaaccaccaugcaccuccaaccaggccaccccacaccaccacccaccccaguucccucaccccaccccgccccagccaugggagccgcaggccuacccggacccggaggaucccucaaaggccuagccggcccccacccagaucuccgaacaggaggcggaggaggaggcggagccggagcaggcaaagcgaagaaauccgucgacaaaaauuccaacgaauaccgagucagacgcgaacgcaacaacauagccguccgaaaaucccgagacaaagccaaacaaagaaacguagaaacacaacaaaaaguccucgaacuaacaagcgacaacgaccgccuacgcaaacgcgucgaacaacucucccgagaacuagacacccuacgcggaaucuuucgccaacuccccgaaucaagccuaguaaaagcuaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 996 - RNA, 1417 nt, Artificial Sequence
  mRNA product Design2 comprising derived and/or modified sequence from Rattus norvegicus__NP_036656.1__RnCebpa(15-344) (opt9)
ggggcgcugccuacggagguggcagccaucuccuucucggcaucaagcuuaccaugucaucccaucuccaaucacccccccacgccccauccaacgccgccuucggcuucccgcggggcgcuggacccgcaccaccccccgcaccccccgccgcacccgaaccccucggcggcaucugcgaacacgaaaccucaauagacaucuccgcauacauagacccagcugccuucaacgaugaauuccuagccgaccucuuccaacacucccgccaacaagaaaaagcaaaagcagcagccggacccgcaggcggaggaggagacuucgacuacccaggagcuccagcaggacccggcggagcagucauguccgcaggcgcacacggacccccacccggcuacggaugcgcagccgcaggcuaccucgacggccgccucgaaccccuauacgaacgcguaggagccccagcccucagaccacucgucauaaaacaagaaccccgagaagaagacgaagccaaacaacuagcccucgccggccucuucccauaccaaccaccaccucccccaccccccccacacccccacgccucaccagcccaccuagccgcaccacaccuacaauuccaaauagcccacugcggucaaacuaccaugcaccuacaacccggccacccaacaccaccaccaacacccgucccauccccccaucccgcacccgcaaugggagccgccggccuacccggccccggaggcucacucaaaggccuagccggcccccaccccgaccuaagaaccggaggcggaggcggcggcggagccggcgccggaaaagcaaaaaaguccguagacaaaaacucaaacgaauaccgagucagacgagaacgcaacaacauagccguccgcaaaucaagagacaaggcaaaacaaagaaacguugaaacccaacagaaaguacucgaacuaaccagcgacaacgaccgccuccgcaaacgcguagaacaauuaucccgugaacuagacacccuccgaggcauauuccgccaacucccagaaucgucccuagucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 997 - RNA, 1462 nt, Artificial Sequence
  mRNA product Design2 comprising derived and/or modified sequence from Mus musculus__NP_031704.2 __MmCebpa (opt9)
ggggcgcugccuacggagguggcagccaucuccuucucggcaucaagcuuaccauggaauccgccgacuucuacgaaguagaaccccgcccacccauguccucucaccuccaaucccccccccacgcaccauccaacgcagccuucggcuucccacgaggcgccggacccgcacccccccccgcacccccagcagcccccgaaccccuuggcggaaucugcgaacacgaaaccucaaucgacauuucagccuacauagaccccgccgcauucaacgacgaguuccuagccgaccucuuccaacacucccgccaacaagaaaaagcaaaagcagcagcaggaccagcaggcggcggaggcgauuucgacuaccccggcgcacccgcaggcccaggcggcgcagucauguccgccggugcccacggcccaccacccggcuacggcugcgccgccgccggcuaccucgacggcagacuagaaccccucuacgaacgugucggcgcccccgcccuacgaccacucgucaucaaacaagaaccucgcgaagaagacgaagcuaaacaacuagcccucgccggccuauucccauaccaacccccccccccgccaccccccccacacccacacgccucccccgcccaccucgcagcaccccaccuccaauuccaaauagcacacugcggccaaaccaccaugcacuuacaacccggacaccccaccccaccccccaccccagucccauccccccacgccgccccagcccucggcgcagccggccuccccggacccggcagcgcucucaaaggccucgccggcgcccaccccgaccuccgcaccggcggcggcgguggcggcucaggugccggcgcgggcaaagccaaaaaaagcguagacaaaaacucaaacgaauaccgcguccgacgcgaacgaaacaacaucgccguucgcaaaagccgagacaaagccaaacaacgcaacgucgaaacccaacaaaaaguacuagaacucacaucagacaacgaccgucuacgaaaacgagucgaacaacuaucacgagaacucgacacacuacgcggaaucuuccgacaacuucccgaaucaucccucguaaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 998 - RNA, 1420 nt, Artificial Sequence
  mRNA product Design2 comprising derived and/or modified sequence from Mus musculus__NP_031704.2 __MmCebpa(15-359) (opt9)
ggggcgcugccuacggagguggcagccaucuccuucucggcaucaagcuuaccauguccagccacuuacaaucacccccccacgcccccuccaacgccgcauucggcuuccccagaggcgccggcccagcacccccuccagcccccccagccgccccagaaccccuuggcggcaucugcgagcacgaaaccucuauagacaucucggcauacaucgaccccgccgccuucaacgacgaauucuuagccgaccuauuccaacacucccgccaacaagaaaaagccaaagccgcagccggacccgccggcggcggaggcgacuucgacuaccccggagcacccgccggccccgggggcgcaguaaugucagccggcgcacacggcccccccccaggcuacggaugcgccgccgccggauaccuagacggccgacucgaaccccucuaugaacgugucggcgcccccgcccuccgaccccuagucaucaaacaagaaccccgcgaagaagacgaagcaaaacaacucgcccucgccggccucuucccauaccaacccccaccccccccaccccccccccacccacacgccucucccgcccaccuagcagcuccccaccuccaauuccaaauagcucacugcggacaaaccacgaugcaccuacaacccggacaccccacuccacccccaacacccguaccuuccccacacgcagcacccgcccucggcgcagcaggccuacccggccccggaucagcccucaaaggccucgcaggcgcccacccagaccuacgaaccggaggcggcggcggcggcuccggagcuggcgccggcaaagccaaaaaaucaguagacaaaaacuccaacgaauaccgaguccgcagagaacgaaacaacaucgcaguccgcaaaucccgcgacaaagccaaacaacgaaacguugaaacacaacaaaaaguacuagaacucaccuccgauaacgaccgacuaagaaaacgagucgaacaacucucccgcgaacucgacacccuaagaggcaucuuccgacaacuccccgaauccucccucgucaaagcaaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 999 - RNA, 1459 nt, Artificial Sequence
  mRNA product Design2 comprising derived and/or modified sequence from Homo sapiens__NP_004355.2__HsCEBPA (opt9)
ggggcgcugccuacggagguggcagccaucuccuucucggcaucaagcuuaccauggaauccgcagacuucuacgaagccgaaccccgaccccccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1000 - RNA, 1417 nt, Artificial Sequence
  mRNA product Design2 comprising derived and/or modified sequence from Homo sapiens__NP_004355.2__HsCEBPA(15-358) (opt9)
ggggcgcugccuacggagguggcagccaucuccuucucggcaucaagcuuaccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1001 - RNA, 1807 nt, Artificial Sequence
  mRNA product Design2 comprising derived and/or modified sequence from Homo sapiens__NP_000448.3__HsHNF4A (opt9)
ggggcgcugccuacggagguggcagccaucuccuucucggcaucaagcuuaccaugcgccuaagcaaaacccuugucgacauggacauggcagacuacucagccgcacucgaccccgcauacacaacacucgaauuugaaaacguacaaguccuaacaaugggcaacgacacaucaccaagcgaagguaccaaucuaaacgcccccaacagccugggcgucucagcucuuugcgcaaucugcggcgaccgcgcaaccgguaaacacuacggcgccuccuccugcgacggcugcaaaggauucuuccgccguuccguucgcaaaaaccacauguacuccugccgauuuagccgacaaugcgucgucgacaaagacaaaagaaaccaaugccgcuauugccgccucaaaaaaugcuuccgcgccggaaugaaaaaagaagcaguccaaaacgaacgcgaccgcaucagcacacgacgaucguccuacgaagacuccucacuacccucaaucaaugcacuccuccaagccgagguccuaucccgacaaaucaccucacccgucuccggcauaaacggcgacauucgcgccaaaaaaaucgccuccaucgccgacgucugcgaguccaugaaagagcaacuccucguccucgucgaaugggccaaauacauccccgcauucugugaacucccccucgacgaccaagucgcccuacuucgcgcccacgccggcgaacaucuccuccuaggcgccaccaagcgguccaugguauucaaagacguccuacuccucggcaacgacuacaucgucccccgacauugcccagaacucgccgaaaugucacgagucuccauccgaauacuugacgaacucguccuacccuuccaagaacuccaaaucgacgacaacgaguacgccuaccuaaaagcaaucaucuucuucgaccccgacgccaaaggacugucagacccaggcaaaaucaaacgccuacgcucccagguucaagucucccuagaagacuauaucaacgaccgccaguacgacuccagaggccgauucggagaacuccuccuacuccuaccgacccuacaauccaucaccuggcaaaugaucgaacagauccaauucaucaaacuauucggaauggccaaaaucgacaaccuacuccaagaaaugcuucucggaggcuccccauccgacgccccccacgcccaccacccucuccacccccaccucaugcaggaacacaugggcaccaacgucaucgucgcaaacacuaugccuacccaccucuccaacggacaaaugugcgaauggccacgcccacgcggccaagccgccacacccgaaaccccacaaccauccccccccggcggaagcggcagcgaaccuuacaaacuccuacccggcgccgucgccacuauagucaaaccucucuccgccaucccacagcccaccaucaccaagcaagaagucaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1002 - RNA, 1012 nt, Artificial Sequence
  mRNA product Design2 comprising derived and/or modified sequence from Homo sapiens__NP_061986.1__HsFGF21 (opt9)
ggggcgcugccuacggagguggcagccaucuccuucucggcaucaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1003 - RNA, 1738 nt, Artificial Sequence
  mRNA product Design2 comprising derived and/or modified sequence from Homo sapiens__NP_078852.3__HsOGFRL1 (opt9)
ggggcgcugccuacggagguggcagccaucuccuucucggcaucaagcuuaccaugggcaaccuacuaggcggagucucauuccgcgaaccaaccaccguagaagacugcgacucaaccuggcaaaccgacuccgaaccagaaccggaggaacccggccccggcggagguagcgagggcccaggccaagaaagcgaacaaccagcccaaccacccgagcaagcaggaggacgccccggcgcaagccccgcacccgacgaagacgccgaagccgccggugccgaacaaggcggagacagcacagaagcaaccgcuaaacccaaacgcagcuucuacgcggcacgagaccuauacaaauaccggcaccaguacccaaacuucaaagacauccgauaccaaaacgaccucuccaaccucagauucuacaaaaacaagauccccuuuaaacccgacggagucuacaucgaagaaguauugagcaaauggaaaggcgacuacgaaaaacucgaacacaaccacacauacauacaauggcuauucccccuaagagaacaaggccugaacuucuacgcaaaagaacuaacaacauacgaaaucgaagaguucaaaaagacaaaagaagcaauccgcagauucuuacucgccuacaaaaugaugcuagaguucuucggcaucaaacuaacagacaaaacaggcaacgucgcccgagccgucaacuggcaggaacgcuuccaacaccucaacgaaucacaacacaacuaucuccggaucacccgaaucuuaaaaucacucggagaacuaggcuacgaaucguucaaaucaccccuaguuaaauucauccuccacgaagcccucguagaaaacaccauccccaacaucaaacaaagcgcgcuagaauacuucgucuacacaauccgcgaccgcagagaacgccgaaaacuacuccgcuucgcucagaaacacuacaccccaagcgaaaacuucaucuggggaccaccccgaaaagaacaauccgagggcuccaaagcccaaaagauguccagcccccucgcaucaucgcacaacagccaaaccucaaugcacaagaaagccaaagacuccaaaaacagcucaagcgccguccaccucaacagcaaaaccgcagaagacaagaaagucgccccaaaagaacccgucgaagagaccgaccgccccucacccgaacccagcaacgaagccgcaaaaccccgcaacaccgaaaaagacagcaacgccgaaaacaugaacucccaacccgagaaaaccguaacaacacccaccgaaaagaaagaaagcguauccccugaaaacaacgaagaaggaggaaacgacaaccaagacaacgaaaacccaggcaacacgaacugccacgacguaguccuaguacaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1004 - RNA, 940 nt, Artificial Sequence
  mRNA product Design2 comprising derived and/or modified sequence from Homo sapiens__NP_008842.1__HsRLN1 (opt9)
ggggcgcugccuacggagguggcagccaucuccuucucggcaucaagcuuaccaugccccgccuauuccucuuccaccuccuagaauuuugccuccuccucaaccaauucucccgcgccgucgccgccaaauggaaagacgacgucaucaaacucugcggccgcgaacucguacgcgcccaaaucgccauaugcggcauguccaccuggucaaaacgcucccucucccaagaagacgccccccaaacaccccgaccagucgcagaaaucguccccuccuucaucaacaaagacacagaaaccaucaucaucaugcucgaauuuaucgcaaaccucccccccgaacucaaagccgcccucuccgaacgccaacccucacuccccgaacuccaacaauacguccccgcccucaaagacuccaaccuuuccuucgaagaauuuaaaaaacuaauccgaaaccgucaaucagaagccgccgacuccaaccccuccgaacucaaauaccuaggccuagacacccacucccaaaaaaaacgacgacccuacgucgcccucuucgaaaaaugcugccucaucggcugcacaaaacgcucccucgcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1005 - RNA, 940 nt, Artificial Sequence
  mRNA product Design2 comprising derived and/or modified sequence from Homo sapiens__NP_604390.1__HsRLN2 (opt9)
ggggcgcugccuacggagguggcagccaucuccuucucggcaucaagcuuaccaugccccgccucuucuucuuccaccuccucggcgucugccuccuccuuaaccaguucucccgcgccguagccgacuccuggauggaagaagucaucaaacucugcggccgcgaacucguccgcgcacaaaucgccaucugcggaaugucaaccugguccaaacgcucacucucccaagaagacgccccccaaaccccccgcccugucgcagaaaucguccccuccuucaucaacaaagacaccgaaaccaucaacaugauguccgaauuugucgccaaccucccccaagaacucaaacucacccuaucagaaaugcaacccgcccuaccccaacuccaacagcacguacccguccucaaagacuccagccuccuauucgaagaauuuaaaaaacucauccgaaaccgacaauccgaagccgcagacucaucacccuccgaacuaaaauaucucggccucgacacccacucccgcaaaaaacgccaacucuacuccgcccucgccaacaaaugcugccacgucggcugcaccaaacgcucacucgcccgcuucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1006 - RNA, 811 nt, Artificial Sequence
  mRNA product Design2 comprising derived and/or modified sequence from Homo sapiens__NP_543140.1__HsRLN3  (opt9)
ggggcgcugccuacggagguggcagccaucuccuucucggcaucaagcuuaccauggcgcgcuacaugcugcuauugcuccuggccgugugggugcucacgggcgagcucuggcccggggcagaggcaagggcagcgcccuauggagugcgauugugcgggcgagaguucauacgcgcggucauauucacgugcgggggaucacgauggcgcaggagcgauaucuuggcccaugaagcgaugggggacacguucccggacgcggacgcggacgaggacucgcuagcgggcgaacucgaugaagcgauggggagcucggaauggcucgcgcucacgaaaucgccacaggccuuuuacaggggcaggcccucguggcagggcacgcccggggucuugcgcgggaguagggacgugcucgcgggauugagcucgagcuguugcaagugggggugcucgaaaucggaaauaagcucgcuauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1007 - RNA, 1792 nt, Artificial Sequence
  mRNA product Design2 comprising derived and/or modified sequence from Homo sapiens__NP_002412.1__HsMMP1 (opt9)
ggggcgcugccuacggagguggcagccaucuccuucucggcaucaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1008 - RNA, 1552 nt, Artificial Sequence
  mRNA product Design2 comprising derived and/or modified sequence from Homo sapiens__NP_002412.1__HsMMP1(1-19,100-469) (opt9)
ggggcgcugccuacggagguggcagccaucuccuucucggcaucaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1009 - RNA, 3739 nt, Artificial Sequence
  mRNA product Design2 comprising derived and/or modified sequence from Clostridium histolyticum__BAA77453.1__ColG (opt9)
ggggcgcugccuacggagguggcagccaucuccuucucggcaucaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1010 - RNA, 3463 nt, Artificial Sequence
  mRNA product Design2 comprising derived and/or modified sequence from Clostridium histolyticum__BAA77453.1__HsALB(1-18)_ColG(111-1118) (opt9)
ggggcgcugccuacggagguggcagccaucuccuucucggcaucaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1011 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt9)
ggggcgcugccuacggagguggcagccaucuccuucucggcaucaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1012 - RNA, 3487 nt, Artificial Sequence
  mRNA product Design2 comprising derived and/or modified sequence from Clostridium histolyticum__BAA34542.1__ColH (opt9)
ggggcgcugccuacggagguggcagccaucuccuucucggcaucaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1013 - RNA, 3448 nt, Artificial Sequence
  mRNA product Design2 comprising derived and/or modified sequence from Clostridium histolyticum__BAA34542.1__ColH (opt9)
ggggcgcugccuacggagguggcagccaucuccuucucggcaucaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1014 - RNA, 3382 nt, Artificial Sequence
  mRNA product Design2 comprising derived and/or modified sequence from Clostridium histolyticum__BAA34542.1__HsALB(1-18)_ColH(41-1021) (opt9)
ggggcgcugccuacggagguggcagccaucuccuucucggcaucaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1015 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt9)
ggggcgcugccuacggagguggcagccaucuccuucucggcaucaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1016 - RNA, 1228 nt, Artificial Sequence
  mRNA product Design2 comprising derived and/or modified sequence from Homo sapiens__NP_003801.1__HsTNFSF10 (opt11)
ggggcgcugccuacggagguggcagccaucuccuucucggcaucaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1017 - RNA, 949 nt, Artificial Sequence
  mRNA product Design2 comprising derived and/or modified sequence from Homo sapiens__NP_003801.1__HsTNFSF10(95-281) (opt11)
ggggcgcugccuacggagguggcagccaucuccuucucggcaucaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1018 - RNA, 1000 nt, Artificial Sequence
  mRNA product Design2 comprising derived and/or modified sequence from Homo sapiens__NP_003801.1__HsALB(1-18)_HsTNFSF10(95-281) (opt11)
ggggcgcugccuacggagguggcagccaucuccuucucggcaucaagcuuaccaugaaaugggucaccuucaucucccuccuauuccucuucuccuccgccuacuccaccuccgaagaaaccaucuccaccguccaagaaaaacaacaaaacaucucaccccuuguccgcgaacgcggcccccaacgcguagccgcccacaucaccggcacccgcggccgcuccaacacccucuccucccccaacuccaaaaacgaaaaagcccucggccgcaaaaucaacuccugggaauccucccgcuccggccacucauuccucuccaaccuccaccuccgaaacggcgaacucgucauccaugaaaaaggcuucuacuacaucuacucccaaaccuacuuccgcuuccaagaagaaaucaaagaaaacaccaaaaacgacaaacaaaugguccaauacaucuacaaauacaccuccuaccccgacccaauccuacuaaugaaauccgcccgcaacuccugcugguccaaagacgccgaauacggacucuacuccauauaccaaggcggcaucuucgaacucaaagaaaacgaccgcaucuucgucuccgucaccaacgaacaccucaucgacauggaccacgaagccuccuucuucggcgccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1019 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt11)
ggggcgcugccuacggagguggcagccaucuccuucucggcaucaagcuuaccaugaagugggugaccuucaucucgcuccuguuccuguucucaagcgcguacucgcgcaugaaacaaaucgaagacaagaucgaggaaauacucucaaaaauauaccacaucgagaacgagaucgcgcgcauaaagaagcuaauaggcgagaccucggaagagaccauaagcacaguccaggaaaagcaacagaacauaagcccgcucgugcgcgagcgcggaccccagcgcguggccgcgcacauaaccgggacccggggccgcaguaacacccugagcucgcccaacagcaagaacgagaaagcacuagggcgaaaaaucaauagcugggaaucgagcagaagcgggcacucauuccuauccaaccuccaccucaggaacggggaacuggucauacacgagaaaggguucuacuacauauacucccaaacauacuuccgauuccaagaagaaauaaaagagaacacgaaaaacgacaagcaaaugguccaguacauauacaaauacacaagcuaccccgaccccauacucuugaugaaaagcgcacgcaacagcugcuggucgaaagacgccgaguacgggcucuacagcauauaccagggcggaaucuucgaacugaaagagaacgaccgcaucuucgugagcguaaccaacgaacaccucauagacauggaccacgaagcgagcuucuucggggccuuccuagugggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1020 - RNA, 1459 nt, Artificial Sequence
  mRNA product Design2 comprising derived and/or modified sequence from Rattus norvegicus__NP_036656.1__RnCebpa (opt11)
ggggcgcugccuacggagguggcagccaucuccuucucggcaucaagcuuaccauggaauccgcagacuucuacgaagccgaaccccgcccacccaugucaucccaccuccaaucaccaccccacgcacccucuaaugccgccuucggauucccccgcggcgccggacccgcacccccacccgcaccacccgccgcccccgaaccccucggaggaaucugcgaacacgaaaccagcaucgacaucucagccuacaucgaccccgccgcauucaacgacgaguuccucgccgaccuuuuccaacacuccagacaacaagaaaaagcaaaagccgcagccggacccgccggcggaggcggcgacuucgauuaccccggcgcccccgccggccccggcggcgcagucauguccgcaggagcccacggcccaccacccggcuacggcugcgccgccgcaggcuaccuagacggucgacuggaaccccucuacgaacgcgucggcgccccugcacuccgcccccucgucauaaaacaagaaccccgagaagaagacgaagccaaacaacucgcccucgccggccuauuccccuaccaaccacccccaccacccccacccccacacccacacgccucaccagcacaccuugccgcaccccaccuacaauuccaaaucgcccacugcggccaaacaacaaugcaccuacaaccuggccaccccaccccaccucccacacccguccccucaccccauccugcccccgccaugggagcagcaggccuacccggaccaggcggcucccuaaaaggccuagccggcccacaccccgaccuacgaacuggcggaggcggcggaggcggcgcaggcgcaggcaaagccaagaaauccgucgacaaaaacuccaacgaauaucgcguccgccgagaacgcaacaacauagccguccgcaaaucccgugacaaagccaaacaacgaaacguagaaacucaacaaaaaguccucgaacucacauccgacaacgaccgccucagaaaacgcgucgaacaacucucccgagaacucgacacccuccgcggcaucuuccgccaacuccccgaaucaucccucgucaaagcaaugggcaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1021 - RNA, 1417 nt, Artificial Sequence
  mRNA product Design2 comprising derived and/or modified sequence from Rattus norvegicus__NP_036656.1__RnCebpa(15-344) (opt11)
ggggcgcugccuacggagguggcagccaucuccuucucggcaucaagcuuaccaugucaucccaccuucaauccccaccccacgcccccuccaacgccgcauucggauucccccgaggagccggcccagcaccaccccccgccccaccagccgcccccgaaccccucggcggaauaugcgaacacgaaaccucaaucgacaucucagcguacauagacccagccgccuucaacgacgaauuccuagcggaccucuuccaacacuccagacaacaagaaaaagcaaaagccgccgccggacccgccggagguggaggagacuucgacuaccccggagcccccgccggacccggcggcgcaguaauguccgccggcgcacacggucccccccccggauacggcugcgcugccgccggcuaccuagacggcagacuagaaccacuauacgaacgcgucggcgccccagcccucagaccacuagucaucaaacaagaaccccgagaagaagacgaagcaaaacaacuagcccuagccggccuauuccccuaccaaccaccccccccaccaccccccccccacccccacgcaucccccgcccaccuagccgccccccaccuccaauuccaaauagcccacugcggccaaacaaccaugcaccuacaacccggacaccccacacccccccccacccccguccccucaccccaccccgcacccgccaugggcgccgccggccuccccggacccggcggcucccuaaaaggacuagccgguccccaccccgaccuccgcaccgggggaggaggcggcggcggcgccggagccggcaaagccaaaaaauccguugacaaaaacucaaacgaauacagagucagacgagaacgcaacaacauugccguccgcaaaucacgcgacaaagcaaaacaacgaaacgucgaaacacaacaaaaaguccucgaacucacuuccgacaacgaccgacuacgcaaacgcgucgaacaacucagccgcgaacucgacacacuccgcggcaucuuccgccaacuacccgaauccucccucguaaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1022 - RNA, 1462 nt, Artificial Sequence
  mRNA product Design2 comprising derived and/or modified sequence from Mus musculus__NP_031704.2 __MmCebpa (opt11)
ggggcgcugccuacggagguggcagccaucuccuucucggcaucaagcuuaccauggaaucagccgacuucuacgaagucgaaccacgccccccaaugucuucccaccuacaaucuccgccccacgcucccucaaacgcagccuucggcuucccacgcggcgccggacccgcccccccacccgccccucccgccgcacccgaaccccucggcggcaucugcgaacacgaaacauccaucgacauaagcgcauacauagaccccgcagcauucaacgacgaauuccucgccgaccucuuccaacacucgcgucaacaagaaaaagcaaaagccgcagccggccccgccggcggcggcggcgacuucgacuaccccggcgcccccgccggucccggaggagccguaaugucggcaggcgcccacggacccccccccggauacggaugcgccgccgccggcuaccuagacggacgccucgaaccccucuacgaaagagucggagcacccgcccuacgcccucucguaaucaaacaagaaccccgcgaagaagacgaagccaaacaacucgcccuagccggacucuuccccuaccaacccccccccccaccacccccaccccacccccacgcaucaccagcccaccuagccgccccccaccuacaauuccaaauagcacacugcggacaaaccaccaugcaccugcaaccaggacacccaacccccccacccaccccaguccccuccccccacgccgcccccgcacucggagccgccggccuacccggccccggcucagcacucaaaggccuugcaggcgcccacccagaccuacguacaggcggaggaggcggcggcuccggcgccggcgccggaaaagccaaaaaauccgucgacaaaaacuccaacgaauaccgcguccgccgcgaacgaaacaacaucgccgucagaaaaucccgcgacaaagcaaaacaacgcaacgucgaaacccaacaaaaaguccuagaauuaaccuccgacaacgacagacuucgcaaacgagucgaacaacuaucacgcgaacucgacacacuccgcggcauauuccgccaacucccagaaucaucccuugucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1023 - RNA, 1420 nt, Artificial Sequence
  mRNA product Design2 comprising derived and/or modified sequence from Mus musculus__NP_031704.2 __MmCebpa(15-359) (opt11)
ggggcgcugccuacggagguggcagccaucuccuucucggcaucaagcuuaccaugucaucccaccuccaauccccaccccacgccccauccaacgcugccuucggauucccccgcggcgccggccccgcacccccacccgccccccccgcugcaccagaacccuuaggcggaauaugcgaacacgaaaccagcauagacaucucagcauacauugaccccgccgccuucaacgacgaauuccucgccgaccucuuccaacacagccgacaacaagaaaaagcaaaagccgcugcaggccccgccggcggcggcggcgacuucgacuaccccggcgccccagccggcccaggcggcgccgucaugucugcaggcgcccacggccccccacccggauacggaugugccgccgccggcuaucucgacggccgccuagaaccacucuacgaaagaguaggcgcccccgcccuccgcccccucgucaucaaacaagaacccagagaagaagacgaagccaaacaacucgcacucgccggccuguuccccuaccaaccccccccacccccaccccccccccacccacacgccucaccagcccaccucgccgccccccaccuccaauuccaaauagcccacugcggccaaaccaccaugcaccuccaaccgggccaccccaccccccccccaacccccguccccucuccccacgcagccccagcauuaggcgccgccggacuaccaggcccaggaucagcccuaaaaggacuagcaggcgcacaccccgaccuccgcacaggcggaggcggaggcggcagcggagccggcgccggaaaagccaaaaaaucagucgauaaaaacucaaacgaauacagaguccgacgcgaacgcaacaacaucgccguccgcaaaucaagagacaaagcuaaacaacgcaacguggaaacucaacaaaaaguccucgaacucaccucagacaacgaccgccuccgcaaacgcgucgaacaacucuccagagaacucgacacccuccgcggaaucuuucgacaacuccccgaauccucacucguaaaagcaaugggcaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1024 - RNA, 1459 nt, Artificial Sequence
  mRNA product Design2 comprising derived and/or modified sequence from Homo sapiens__NP_004355.2__HsCEBPA (opt11)
ggggcgcugccuacggagguggcagccaucuccuucucggcaucaagcuuaccauggaaagcgcagacuucuacgaagcagaaccccgaccccccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1025 - RNA, 1417 nt, Artificial Sequence
  mRNA product Design2 comprising derived and/or modified sequence from Homo sapiens__NP_004355.2__HsCEBPA(15-358) (opt11)
ggggcgcugccuacggagguggcagccaucuccuucucggcaucaagcuuaccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1026 - RNA, 1807 nt, Artificial Sequence
  mRNA product Design2 comprising derived and/or modified sequence from Homo sapiens__NP_000448.3__HsHNF4A (opt11)
ggggcgcugccuacggagguggcagccaucuccuucucggcaucaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgccuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1027 - RNA, 1012 nt, Artificial Sequence
  mRNA product Design2 comprising derived and/or modified sequence from Homo sapiens__NP_061986.1__HsFGF21 (opt11)
ggggcgcugccuacggagguggcagccaucuccuucucggcaucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1028 - RNA, 1738 nt, Artificial Sequence
  mRNA product Design2 comprising derived and/or modified sequence from Homo sapiens__NP_078852.3__HsOGFRL1 (opt11)
ggggcgcugccuacggagguggcagccaucuccuucucggcaucaagcuuaccaugggcaaccuccuaggcggagucucauuccgcgaacccaccacaguagaagacugcgacuccaccuggcaaacagacuccgaacccgaaccagaggaaccuggacccggcggcggaucggaaggacccggccaagaaagcgagcagcccgcacaaccacccgaacaagccgguggacgcccaggcgccucacccgccccagacgaggacgccgaagccgccggcgcagagcagggcggagacagcacugaagccacagcaaaaccuaaacgcuccuucuacgccgcccgagaccucuacaaauacagacaccaauaccccaacuucaaagacauucgauaccaaaacgaccucuccaaccuccgcuucuacaaaaacaaaaucccauucaaacccgacggagucuacauagaagaaguccucuccaaauggaaaggcgacuacgaaaaacuggaacacaaccacacauacauccaauggcucuuuccccuccgcgaacaaggccucaacuucuacgccaaagaacuaaccacauacgagaucgaagaauuuaaaaaaacuaaagaagccauacgccgcuuccuacucgccuacaaaaugaugcuagaguucuucggcaucaaacucaccgacaaaaccggcaacgucgcccgagccgucaacuggcaagaacgauuccaacaccucaacgaaucccaacacaacuaccuacgcauaacccgcauacuaaaaucccuuggcgaacucggauacgaauccuucaaauccccacuugucaaguucauccuccacgaagcucuagucgaaaacacaauaccaaacauaaaacaguccgcacucgaauacuucgucuacaccauccgcgaccgccgcgagcgccgcaaacuccuccgcuucgcccagaaacacuacacccccuccgaaaacuucaucuggggacccccaagaaaagaacaaucagaaggaucaaaagcucaaaagaugagcuccccacuagccucaucacacaacucccaaaccuccaugcacaaaaaagccaaagacucaaaaaauuccagcucagccguccaccucaacucaaaaaccgcagaggacaaaaaagucgcacccaaagaacccguagaagaaaccgaccgaccaucacccgaaccauccaacgaagcagccaaaccacgcaacacagagaaagacuccaacgccgaaaacaugaacucccaacccgaaaaaacagugaccacacccaccgaaaaaaaagaauccguaucccccgaaaacaacgaggaaggcggaaacgacaaccaagacaacgaaaaccccggcaacaccaacugccaugacgucguccuaguccaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1029 - RNA, 940 nt, Artificial Sequence
  mRNA product Design2 comprising derived and/or modified sequence from Homo sapiens__NP_008842.1__HsRLN1 (opt11)
ggggcgcugccuacggagguggcagccaucuccuucucggcaucaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgccccccaaaccccccgccccgucgccgagaucguccccuccuucaucaacaaagacaccgaaaccaucaucaucaugcucgaauuuaucgccaaccucccccccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugccuaaucggcugcaccaaacgcucccucgccaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1030 - RNA, 940 nt, Artificial Sequence
  mRNA product Design2 comprising derived and/or modified sequence from Homo sapiens__NP_604390.1__HsRLN2 (opt11)
ggggcgcugccuacggagguggcagccaucuccuucucggcaucaagcuuaccaugccccgccucuucuucuuccaccuccucggcgucugccuccuccuaaaccaauucucccgagccgucgccgacuccuggauggaagaagucaucaaacuaugcggccgcgaacucguccgcgcccaaaucgccaucugcggcauguccaccugguccaaacgcucccucucccaagaagacgccccccaaaccccccgccccgucgccgaaaucguccccuccuucaucaauaaagacaccgaaaccauaaacaugauguccgaauuugucgcaaaccucccccaagaacucaaacucacccucuccgaaaugcaacccgcccucccccaacuacaacaacacguccccguccucaaagacuccucccuacucuucgaagaauuuaaaaaacucauccgcaaccgccaaucagaagccgccgacuccuccccauccgaacucaaauaccucggccucgacacccacucccgaaaaaaacgccaacucuacagcgcccucgccaacaaaugcugccacgucggcugcaccaaacgcucccucgcccgcuucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1031 - RNA, 811 nt, Artificial Sequence
  mRNA product Design2 comprising derived and/or modified sequence from Homo sapiens__NP_543140.1__HsRLN3  (opt11)
ggggcgcugccuacggagguggcagccaucuccuucucggcaucaagcuuaccauggcgcgcuauauguugcuauugcucuuggccgugugggugcucacgggcgagcucuggcccggggccgaggccagggccgcgcccuauggcgugcgcuugugcgggcgcgaguucauacgagcggucauauucacgugcgggggcucgcgcuggcgcaggagcgauauauuggcccaugaagcgaugggggacacguucccggacgcggacgcggacgaggacucgcucgcgggcgagcucgaugaagcgauggggagcucggaauggcuagcgcuaacgaaaucgccccaggccuuuuacaggggcaggcccucguggcagggaacgcccgggguauugcgagggagcagggacgugcucgcgggcuugagcucaagcuguugcaagugggggugcucgaaaucggaaauaagcucgcucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1032 - RNA, 1792 nt, Artificial Sequence
  mRNA product Design2 comprising derived and/or modified sequence from Homo sapiens__NP_002412.1__HsMMP1 (opt11)
ggggcgcugccuacggagguggcagccaucuccuucucggcaucaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1033 - RNA, 1552 nt, Artificial Sequence
  mRNA product Design2 comprising derived and/or modified sequence from Homo sapiens__NP_002412.1__HsMMP1(1-19,100-469) (opt11)
ggggcgcugccuacggagguggcagccaucuccuucucggcaucaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1034 - RNA, 3739 nt, Artificial Sequence
  mRNA product Design2 comprising derived and/or modified sequence from Clostridium histolyticum__BAA77453.1__ColG (opt11)
ggggcgcugccuacggagguggcagccaucuccuucucggcaucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1035 - RNA, 3463 nt, Artificial Sequence
  mRNA product Design2 comprising derived and/or modified sequence from Clostridium histolyticum__BAA77453.1__HsALB(1-18)_ColG(111-1118) (opt11)
ggggcgcugccuacggagguggcagccaucuccuucucggcaucaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1036 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt11)
ggggcgcugccuacggagguggcagccaucuccuucucggcaucaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1037 - RNA, 3487 nt, Artificial Sequence; identical to SEQ ID NO: 812
  mRNA product Design2 comprising derived and/or modified sequence from Clostridium histolyticum__BAA34542.1__ColH (opt11)

SEQ ID NO: 1038 - RNA, 3448 nt, Artificial Sequence
  mRNA product Design2 comprising derived and/or modified sequence from Clostridium histolyticum__BAA34542.1__ColH (opt11)
ggggcgcugccuacggagguggcagccaucuccuucucggcaucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1039 - RNA, 3382 nt, Artificial Sequence
  mRNA product Design2 comprising derived and/or modified sequence from Clostridium histolyticum__BAA34542.1__HsALB(1-18)_ColH(41-1021) (opt11)
ggggcgcugccuacggagguggcagccaucuccuucucggcaucaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1040 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt11)
ggggcgcugccuacggagguggcagccaucuccuucucggcaucaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1041 - RNA, 1228 nt, Artificial Sequence
  mRNA product Design2 comprising derived and/or modified sequence from Homo sapiens__NP_003801.1__HsTNFSF10 (opt12)
ggggcgcugccuacggagguggcagccaucuccuucucggcaucaagcuuaccauggcaaugauggaaguacaaggaggacccagccuaggacaaacaugcguacuaauaguaauauucacaguacuacuacaaucacuuugcguugcaguaacauacguauacuucacaaacgaacuaaaacaaaugcaagacaaauacucaaaaucaggaauagcaugcuucuuaaaagaagaugacucuuacugggacccaaacgacgaagaaagcaugaauagccccugcuggcaaguaaaauggcaacuaagacaacucguacgaaaaaugauacuacgaacaucagaagaaacaauaucaacaguacaagaaaaacaacaaaacauauccccauuaguaagagaaagaggaccacaaagaguagcagcacacauaacaggaacaagaggaagaucaaacacacuaucaaguccaaacaguaaaaacgaaaaagcacuaggaagaaaaauaaacagcugggaaaguaguagaucaggacacucauuccuaucaaaccuacaccuaagaaacggagaauuaguaauccaugaaaaaggauucuacuacauauacucacaaacauauuucagauuccaagaagaaauaaaagaaaauacuaaaaacgacaaacaaaugguccaauauauauacaaauauacaucauacccagacccaauacuacuaaugaaaucagcaagaaacucaugcuggucaaaagaugcagaauauggacuauacucaauauaccaaggaggaauauucgaacuaaaagaaaaugacagaauauuuguaucaguaacaaacgaacaccuaauagacauggaccacgaagcaucauuuuucggcgccuuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1042 - RNA, 949 nt, Artificial Sequence
  mRNA product Design2 comprising derived and/or modified sequence from Homo sapiens__NP_003801.1__HsTNFSF10(95-281) (opt12)
ggggcgcugccuacggagguggcagccaucuccuucucggcaucaagcuuaccaugacaucagaagaaacaauaagcacaguacaagaaaaacaacaaaacauaucaccacuuguaagagaaagaggaccacaaagaguagcagcacacauaacaggaacaagaggaagaucaaacacacuaagcucaccaaacucaaaaaacgaaaaagcacuaggaagaaaaauaaacucaugggaaucaagcagaucaggacacucauuccuaucaaaccuacaccuaagaaacggagaacuuguaauacacgaaaaaggauucuacuacauauacucacaaacauacuucagauuccaagaagaaauaaaagaaaacacaaaaaacgacaaacaaaugguacaauacauauacaaauacacaucauacccagacccaauacuacuaaugaaaagcgcaagaaacagcuguuggucaaaagaugcagaauacggacuauacucaauauaccaaggaggaaucuucgaauuaaaagaaaacgacagaauauucguaucaguaacaaacgaacaccuaauagacauggaccacgaagcaucauucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1043 - RNA, 1000 nt, Artificial Sequence
  mRNA product Design2 comprising derived and/or modified sequence from Homo sapiens__NP_003801.1__HsALB(1-18)_HsTNFSF10(95-281) (opt12)
ggggcgcugccuacggagguggcagccaucuccuucucggcaucaagcuuaccaugaaauggguaacauucauaucacuacuauuccuauucucaagcgcauacucaacaucagaagaaacaauaucaacaguacaagaaaaacaacaaaacauaucaccauuaguaagagaaagaggaccacaaagaguagcagcacacauaacaggaacaagaggaagaagcaacacacuaagcucaccaaacaguaaaaacgaaaaagcacuaggaagaaaaauaaacucaugggaaucaucaagaucaggacacucauuccuaucaaaccuacaccuaagaaacggagaauuaguaauacacgaaaaaggauucuacuauauauacucacaaacauacuucagauuccaagaagaaauaaaagaaaacaccaaaaacgacaaacaaaugguacaauacauauacaaauacacaucauacccagacccaauacuacuaaugaaaagcgcaagaaacucaugcuggucaaaagacgcagaauacggacuauacagcauauaccaaggaggaauauucgaacuaaaagaaaacgacagaauauucguaucagucacaaacgaacacuuaauagacauggaccacgaagcaucauucuucggagcauucuuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1044 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt12)
ggggcgcugccuacggagguggcagccaucuccuucucggcaucaagcuuaccaugaaauggguaacauucauaucgcuacuauucuuauucucaagcgcauacucaagaaugaaacaaauagaagacaaaauagaagaaauacucucaaaaauauaccauaucgaaaacgaaauagcaagaauaaaaaaacuaauaggcgaaacuucagaagaaacaauaagcacaguacaagaaaaacaacaaaacauaagcccacuuguaagagaaagaggaccacaaagaguagcagcacauauaacaggaacaagaggaagaagcaacacacuaagcucaccaaacaguaaaaacgaaaaagcacuuggacgaaaaauaaauagcugggaaucaucaagaagcggacacucguuccuaagcaaccuacaccuaagaaacggagaacuuguaauacacgaaaaaggauucuacuacauauacucacaaacauauuuuagauuccaagaagaaauaaaagaaaacacaaaaaacgacaaacaaaugguacaauacauauacaaauacacaucauacccagacccaauacuccuaaugaaaagcgcaagaaacagcugcuggucaaaagaugcagaauacggacuauacagcauauaccaaggaggaauauuugaacuaaaagaaaacgauagaauauucguaaguguaacaaacgaacaccuaauagacauggaccacgaagcuagcuucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1045 - RNA, 1459 nt, Artificial Sequence
  mRNA product Design2 comprising derived and/or modified sequence from Rattus norvegicus__NP_036656.1__RnCebpa (opt12)
ggggcgcugccuacggagguggcagccaucuccuucucggcaucaagcuuaccauggaaucagcagacuuuuaugaagcugaaccaagaccccccaugucaucccacuuacaaucacccccacaugcuccaucaaacgcagcauuuggauucccaaggggagcaggcccugcaccaccaccagcaccaccagcagcaccagaaccauuaggagguauuugugaacacgaaacaucaauagacauauccgcuuauauagauccagcagcauuuaaugaugaauuucuagcagaucuuuuucaacauaguagacaacaagaaaaagcaaaagcagcagcugguccagcuggaggaggaggagacuucgauuauccaggagcaccugcagggccuggaggagcggucaugagugcaggugcacauggaccaccuccaggauauggaugugcagcagccggauauuuagauggaagacuagaaccauuauaugaaagaguaggcgcaccagcauuaagaccauuaguaauaaaacaagaaccaagagaagaagacgaagcaaaacaauuagcacuagcaggacuauucccauaucaaccuccaccuccaccaccaccaccacacccacaugcaucaccagcacauuuagcagcaccacauuuacaauuucaaauugcacauuguggacaaacaacaaugcauuuacaaccaggacauccaacaccaccaccaacaccaguaccuucaccacauccagcaccagcaaugggcgcagcagguuuaccaggaccaggaggaaguuuaaaaggcuuagcugguccucauccagaccuaagaaccggaggaggaggaggaggaggagcaggagcaggaaaagcaaaaaaaaguguagauaaaaauucaaaugaauauagaguaagaagagaaagaaacaauauagcaguaagaaaaucuagagauaaagcgaaacaaagaaauguagaaacacaacaaaaaguguuagaacuaacaucagacaacgauagauuaagaaaaagaguagaacaauuaucgagagaacuugauacccuacgaggaauauuucgacaauuaccugaaucaucauuaguaaaagcaauggguaauugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1046 - RNA, 1417 nt, Artificial Sequence
  mRNA product Design2 comprising derived and/or modified sequence from Rattus norvegicus__NP_036656.1__RnCebpa(15-344) (opt12)
ggggcgcugccuacggagguggcagccaucuccuucucggcaucaagcuuaccaugucaucacaucuacaaucaccaccucaugcaccuucaaaugcagccuuuggauucccaagaggagcaggaccagcaccaccaccagcaccaccagcagcaccagaaccauuaggaggaauaugcgaacaugaaacaucaaucgauauauccgcauauauagauccagcagcauucaaugaugaauuuuuagcagauuuauuucaacauagucgacaacaagaaaaagcaaaagcagcagcaggcccagcaggcggcggaggagacuuugauuacccuggagcaccagcuggacccggaggagcaguaaugucagcaggagcacaugguccaccaccaggauauggaugcgcagcagcaggauacuuagauggaagacuagaaccauuauaugaaagaguaggagcaccugcauuaagaccauuaguuaucaaacaagaaccaagagaagaagaugaagcaaaacaauuagcauuagcaggacuauuuccauaucaaccaccaccaccaccaccaccaccacauccacaugcaucaccagcucaucuagcagcaccucauuuacaauuucaaauagcacauuguggucaaacaacaaugcaucuacaaccaggacauccaacaccaccaccaacuccaguuccaucaccacauccagcaccagcaaugggagcagcaggacuaccaggaccaggaggaucauuaaaaggacuagcaggaccacauccugaucuaaggacaggcggcggaggaggaggaggugcaggagcuggaaaagcuaaaaaaucaguagauaaaaauucaaacgaauauagaguaagacgcgaaagaaauaauauugcgguacgaaaaucaagagauaaagcaaaacaacgaaauguagaaacacaacaaaaaguacuagaauuaacaagugauaacgaccgucuaagaaaaagaguagaacaacuaucaagagaauuagauacucuaagagguaucuuuagacaacuaccagaaucaucauuaguuaaagcaaugggaaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1047 - RNA, 1462 nt, Artificial Sequence
  mRNA product Design2 comprising derived and/or modified sequence from Mus musculus__NP_031704.2 __MmCebpa (opt12)
ggggcgcugccuacggagguggcagccaucuccuucucggcaucaagcuuaccauggaaucagcagacuuuuaugaaguagaaccuagaccaccaaugaguucacauuuacaaucaccaccacaugcuccaucaaaugcagccuuuggauuuccuagaggagcaggaccagcaccaccaccagcuccaccagcugcaccagaaccauuaggaggaauaugugaacaugaaacaucaauagauauaucagcauacauagacccagcugcauuuaaugacgaauuucuagcugaucuuuuccaacacucaagacaacaagaaaaagcaaaagcagcagcuggaccagcaggaggaggaggagauuuugauuauccuggagcaccagcaggaccuggaggagcaguaaugucagcuggugcacauggaccuccaccaggauacgguugugcagcagcaggcuacuuagacggacgauuagaaccauuauacgaaagaguaggcgcuccagcacuuagaccuuuagucauuaaacaggaaccaagagaagaagaugaagcaaaacaacuagcuuuagcaggacuauuuccauaucaaccacccccaccaccaccaccuccacacccacaugcaucaccugcacaucuagcugcaccacauuuacaauuccaaauagcacauuguggucaaacaaccaugcauuuacaacccggacauccaaccccaccuccaacacccguuccuucuccacaugcagcaccagcacuaggagcagcagguuuaccaggacccggaagugcauuaaaaggauuagcaggagcacauccagauuuaagaacuggcgguggugguggaggaaguggagcuggugcaggaaaagccaaaaaaucaguagauaaaaauucuaacgaauauagaguaagaagagaaagaaauaauauugcuguaagaaaaucaagagauaaagccaaacaaagaaauguagaaacacaacaaaaaguauuagaauuaacaagcgauaaugauagguuaagaaaaagaguagaacaacugucuagagaauuagauacauuaagaggaauauuuagacaacuaccagaauccucacuaguaaaagcaaugggcaauugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1048 - RNA, 1420 nt, Artificial Sequence
  mRNA product Design2 comprising derived and/or modified sequence from Mus musculus__NP_031704.2 __MmCebpa(15-359) (opt12)
ggggcgcugccuacggagguggcagccaucuccuucucggcaucaagcuuaccaugaguagccacuuacaaucaccaccacaugcaccaucaaaugccgcauuuggauucccacgaggugcagguccagcaccaccuccagcaccaccagcagcaccagaaccauuaggaggaauuugugaacaugaaacaucaauagauauuucagcauauauagauccugcagcauuuaaugaugaauuuuuagcagauuuauuucaacauaguagacaacaagaaaaagcaaaagcagcugcuggcccagcaggaggaggcggagauuucgauuauccuggagcaccagcaggaccuggaggagcaguaaugagugcaggugcacacggaccacccccaggauauggaugugcagcagcaggauacuuagaugguagauuagaaccauuauaugaaaggguaggugcaccagcacuaagaccauuaguaauaaaacaagaaccaagagaagaagacgaagcaaaacaauuagcauuagcuggauuauuucccuaccaaccacccccaccaccaccuccaccacacccacaugcuucaccagcucauuuagcagcaccucauuuacaauuucaaauagcucauugcggacaaacaacaaugcaucuacaaccaggacauccaacaccaccuccaacaccaguaccaucaccucaugcugcaccagcacuaggugcagcuggauuacccggaccaggaucagcauuaaaaggauuagcaggagcucauccagauuuaagaacagguggaggagguggugguucuggagcaggagcagguaaagcaaaaaaaaguguagauaaaaauaguaacgaauacagaguaagaagagaacgaaauaauauagcaguuagaaaaucaagagauaaagcaaaacaaagaaauguagaaacacaacaaaaaguccuagaauuaacaucagauaaugacagauuaagaaaaagaguagaacaauuaucacgagaacuugauacauuaagaggaauauuuagacaauuaccugaauccucucuaguaaaagcaaugggaaauugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1049 - RNA, 1459 nt, Artificial Sequence
  mRNA product Design2 comprising derived and/or modified sequence from Homo sapiens__NP_004355.2__HsCEBPA (opt12)
ggggcgcugccuacggagguggcagccaucuccuucucggcaucaagcuuaccauggaaagcgcugauuuuuaugaagcagaaccaagaccaccaaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1050 - RNA, 1417 nt, Artificial Sequence
  mRNA product Design2 comprising derived and/or modified sequence from Homo sapiens__NP_004355.2__HsCEBPA(15-358) (opt12)
ggggcgcugccuacggagguggcagccaucuccuucucggcaucaagcuuaccaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1051 - RNA, 1807 nt, Artificial Sequence
  mRNA product Design2 comprising derived and/or modified sequence from Homo sapiens__NP_000448.3__HsHNF4A (opt12)
ggggcgcugccuacggagguggcagccaucuccuucucggcaucaagcuuaccaugagacuaucaaaaacauuagucgacauggauauggcagacuacuccgcugcauuagauccagcauacacaacacuugaauuugaaaacguacaaguacuaacgaugggaaacgacaccucaccaagcgaaggaaccaauuuaaacgcacccaauucauuaggaguuucagcauuaugcgcaauaugcggagauagagcaacagggaaacauuauggagccucaaguugcgacggauguaaagguuucuucagaagaucaguaagaaaaaaccacauguacucaugcagauuuucuagacaaugcguaguagacaaagauaaacgaaaucaaugcagauauuguagauuaaaaaaauguuucagagcaggaaugaaaaaagaagcuguccaaaaugaacgagaucgaauaagcacacgacgauccucauaugaagauucaucacuaccauccauaaacgcauuacuacaagcagaagucuuaucaagacaaauaacaucaccaguaucaggaaucaacggagauauaagagcaaaaaaaauugcaucaauagcagauguaugcgaaucaaugaaagaacaauuacuuguccuuguagaaugggccaaauacauaccagcauuuugugaacuaccacuagacgaucaaguagcauuauuaagagcacacgccggagaacacuuauuacucggagcaacaaaaagauccaugguauuuaaagacguacuuuuacuaggcaaugauuacauaguaccucgucacuguccagaacuagcagaaaugucacgaguaucaauaagaauccuagaugaacuuguacuaccauuccaagaauuacaaauagacgacaacgaauacgcauaccucaaagcuauaauauucuuugacccagacgcaaaaggcuuaucugauccaggaaaaaucaaaagauuaagaucacaaguacaaguaucauuagaagacuacauaaacgauagacaauacgauucaagaggcagauuuggagaacuauuauuacuacuacccacacuacaaucuauaacauggcaaaugauugagcaaauacaguuuauaaaacuauucggaauggcaaaaauagacaaccuauuacaagaaaugcuacuaggaggcucaccaagugaugccccccacgcacaccauccacuccacccacaccucaugcaagaacacaugggaacaaauguuauaguagcaaacacuaugccaacccacuuaucuaauggacaaaugugcgaauggccaagaccacguggucaagcagcgacaccugaaacaccacaaccaaguccaccaggcgguucaggaucagaacccuauaaauuauuacccggagccguagcaacaauaguaaaaccacuaucugcuauaccacaaccaacaauaacaaaacaagaaguaauauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1052 - RNA, 1012 nt, Artificial Sequence
  mRNA product Design2 comprising derived and/or modified sequence from Homo sapiens__NP_061986.1__HsFGF21 (opt12)
ggggcgcugccuacggagguggcagccaucuccuucucggcaucaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1053 - RNA, 1738 nt, Artificial Sequence
  mRNA product Design2 comprising derived and/or modified sequence from Homo sapiens__NP_078852.3__HsOGFRL1 (opt12)
ggggcgcugccuacggagguggcagccaucuccuucucggcaucaagcuuaccaugggaaacuuauuaggaggaguaucauuccgagaaccuacgaccguugaagacugcgacucaacauggcaaacagacucugaaccagaaccagaagaaccuggaccaggcggaggaagcgaaggcccaggacaagaauccgaacaaccagcacaaccaccagaacaagcaggaggaagaccuggagcaucgcccgccccagaugaagacgcagaagccgcaggagcagaacaaggaggcgacuccacagaagccacagcaaaaccaaaacgaucauucuacgcugcacgcgaucuauacaaauauagacaccaauauccaaacuucaaagauauaagauaccaaaaugacuuaagcaacuuacgguucuacaaaaacaaaaucccauuuaaaccagacggaguauacauagaagaaguacuaucaaaauggaaaggagacuacgaaaaacuagaacacaaccacacauacauacaaugguuauucccuuuaagagaacaaggacucaauuucuaugcaaaagaacuaaccacauacgaaauugaagaauuuaaaaaaacaaaagaagcaaucagaagauucuuacuagcauacaaaaugaugcuagaauuuuuuggaauaaaacucacagacaaaacaggaaacguagccagagcaguuaacuggcaagaacgcuuucaacaucuaaacgaaucacaacacaacuaucucagaauaacaagaauacuaaaaucacugggagaauuaggcuacgaaucauuuaaaucaccacuuguaaaauucauauuacacgaagcacucguagaaaacacaauaccaaauauaaaacaaucugcccucgaauauuuugucuacaccaucagagauagacgcgaaagaagaaaauuauuacgauucgcacaaaaacauuacacaccaucagaaaacuucauauggggaccaccaagaaaagaacaauccgaaggaaguaaagcacaaaaaaugucaucaccacuagcauccucacacaacagucaaacaagcaugcacaaaaaagcaaaagacagcaaaaacucaucaagugcaguacaccuaaacucaaaaacagcagaagauaaaaaaguagcuccuaaagaaccgguugaagaaacagaucgaccaucaccagaaccaagcaacgaagcagcaaaaccuagaaacacagaaaaagacucaaaugcagaaaacaugaauagccaaccugaaaaaacaguaaccacaccaacagaaaaaaaagaaaguguaaguccagaaaacaaugaagaaggagguaacgacaaucaagauaacgaaaacccaggcaauaccaacugucaugacguaguucuaguacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1054 - RNA, 940 nt, Artificial Sequence
  mRNA product Design2 comprising derived and/or modified sequence from Homo sapiens__NP_008842.1__HsRLN1 (opt12)
ggggcgcugccuacggagguggcagccaucuccuucucggcaucaagcuuaccaugccaagacuauucuuauuccacuuacuagaauuuugccuacuacuaaaccaauucucaagagcagucgcagcaaaauggaaagacgacguaauaaaacuaugcggaagagaacuuguaagagcacaaauagcaauaugcggaauguccacauggucaaaaagaucacuaucacaagaagacgcaccacaaacaccaagaccaguagcagaaauaguaccuagcuucauaaacaaagacacagaaacaauaauaauaauguuagaauuuauagccaaccuaccacccgaacuaaaagcagcauuaagcgaaagacaaccaucauuaccagaauuacaacaauacguaccagcacuaaaagacucaaaccuaucauucgaagaauuuaaaaaauuaauaagaaacagacaaucagaagcagcagauucaaacccaucagaacuaaaauaccuaggacuagacacacacucacaaaaaaaaagaagaccauacguagcacuauucgaaaaaugcugccuaauaggaugcacaaaacgaucauuagcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1055 - RNA, 940 nt, Artificial Sequence
  mRNA product Design2 comprising derived and/or modified sequence from Homo sapiens__NP_604390.1__HsRLN2 (opt12)
ggggcgcugccuacggagguggcagccaucuccuucucggcaucaagcuuaccaugccaagacuauucuucuuccacuuacuaggaguaugcuuacuacuaaaccaauucucaagagcaguagcagacucauggauggaagaaguaauaaaacuaugcggcagagaacuuguaagagcacaaauagcaauaugcggaaugucaaccuggucaaaaagaucacuaucacaagaagacgcaccacaaacaccacgaccaguagcagaaauaguaccaucauucauaaacaaagacacagaaacaauaaacaugaugucagaauuuguagcaaacuuaccccaagaacuaaaauuaacauuaucagaaaugcaaccagcacuaccacaacuacaacaacacguaccaguacuaaaagacucaucacuacuauucgaagaauuuaaaaaacuaauaagaaacagacaaucagaagcagcagacucaucaccaucagaauuaaaauaccuaggacuagacacacacagcagaaaaaaacgacaacuauacagcgcacuagcaaacaaaugcugccacguaggaugcacaaaaagaucacuagcaagauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1056 - RNA, 811 nt, Artificial Sequence
  mRNA product Design2 comprising derived and/or modified sequence from Homo sapiens__NP_543140.1__HsRLN3  (opt12)
ggggcgcugccuacggagguggcagccaucuccuucucggcaucaagcuuaccauggcaagguauauguuauuauuauuacuagcaguauggguauuaacaggagaauuauggccaggagcagaagcaagagcagcaccauauggagugagauuauguggaagagaauuuauaagagcaguaauauuuacauguggaggaaguagauggagaagaagugauauauuagcacaugaagcaaugggagauacauuuccagaugcagaugcagaugaagauucauuagcaggagaauuagaugaagcaaugggaaguagugaaugguuagcauuaacaaaaagcccacaagcauuuuauagaggaagaccaaguuggcaaggaacaccaggaguauuaagaggaaguagagauguauuagcaggauuaaguaguaguuguuguaaauggggauguaguaaaagugaaauaaguaguuuauguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1057 - RNA, 1792 nt, Artificial Sequence
  mRNA product Design2 comprising derived and/or modified sequence from Homo sapiens__NP_002412.1__HsMMP1 (opt12)
ggggcgcugccuacggagguggcagccaucuccuucucggcaucaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1058 - RNA, 1552 nt, Artificial Sequence
  mRNA product Design2 comprising derived and/or modified sequence from Homo sapiens__NP_002412.1__HsMMP1(1-19,100-469) (opt12)
ggggcgcugccuacggagguggcagccaucuccuucucggcaucaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1059 - RNA, 3739 nt, Artificial Sequence
  mRNA product Design2 comprising derived and/or modified sequence from Clostridium histolyticum__BAA77453.1__ColG (opt12)
ggggcgcugccuacggagguggcagccaucuccuucucggcaucaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1060 - RNA, 3463 nt, Artificial Sequence
  mRNA product Design2 comprising derived and/or modified sequence from Clostridium histolyticum__BAA77453.1__HsALB(1-18)_ColG(111-1118) (opt12)
ggggcgcugccuacggagguggcagccaucuccuucucggcaucaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1061 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt12)
ggggcgcugccuacggagguggcagccaucuccuucucggcaucaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1062 - RNA, 3487 nt, Artificial Sequence
  mRNA product Design2 comprising derived and/or modified sequence from Clostridium histolyticum__BAA34542.1__ColH (opt12)
ggggcgcugccuacggagguggcagccaucuccuucucggcaucaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1063 - RNA, 3448 nt, Artificial Sequence
  mRNA product Design2 comprising derived and/or modified sequence from Clostridium histolyticum__BAA34542.1__ColH (opt12)
ggggcgcugccuacggagguggcagccaucuccuucucggcaucaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1064 - RNA, 3382 nt, Artificial Sequence
  mRNA product Design2 comprising derived and/or modified sequence from Clostridium histolyticum__BAA34542.1__HsALB(1-18)_ColH(41-1021) (opt12)
ggggcgcugccuacggagguggcagccaucuccuucucggcaucaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1065 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt12)
ggggcgcugccuacggagguggcagccaucuccuucucggcaucaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1066 - RNA, 1228 nt, Artificial Sequence
  mRNA product Design2 comprising derived and/or modified sequence from Homo sapiens__NP_003801.1__HsTNFSF10 (opt13)
ggggcgcugccuacggagguggcagccaucuccuucucggcaucaagcuuaccauggcaaugauggaaguccaaggaggacccucacuaggacaaacaugcguacuaauaguaauauucacaguacuacuacaaucacuaugcguagcaguaacauacgucuacuuuacaaacgaacuuaaacaaaugcaagauaaauacucaaaaucaggaauagcaugcuucuuaaaagaagaugacucauacugggacccaaacgacgaagaaucaaugaauagcccaugcuggcaaguaaaauggcaacuaagacaacuuguaagaaaaaugauacuaagaacaucagaagaaacaauaucaacaguacaagaaaaacaacaaaacauaucaccauuaguaagagaaagaggcccacaacgcguagcagcacacauaacaggaacaagaggaagaucaaacacacuaucaucaccaaauucaaaaaaugaaaaagcauuaggacgaaaaaucaacucaugggaaucaucaagaucaggacauucauucuuaaguaaucuacacuuacgaaacggagaauuaguaauacacgaaaaaggauucuacuacauauacucacaaacauacuucagauuccaagaagaaauaaaagaaaacacaaaaaacgacaaacaaaugguacaauacauauauaaauauacaagcuacccagacccaauauuauuaaugaaaagugcaagaaauagcugcuggucaaaagacgcagaauauggacuauacucaauauaccaaggaggaauauucgaacuaaaagaaaacgaccgaauauucguaucaguaacaaacgaacaccuaauagacauggaccacgaagcaucauucuucggagcauuccucgucggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1067 - RNA, 949 nt, Artificial Sequence
  mRNA product Design2 comprising derived and/or modified sequence from Homo sapiens__NP_003801.1__HsTNFSF10(95-281) (opt13)
ggggcgcugccuacggagguggcagccaucuccuucucggcaucaagcuuaccaugacaucagaagaaacaauaucaacaguacaagaaaaacaacaaaacauaucaccccuaguaagagaaagaggaccacaacgaguagcagcacacauaacaggaacaagaggacgaucaaacacacuaucaucaccaaacuccaaaaacgaaaaagcacuaggaagaaaaauaaacucaugggaaucaucaagaagcggacacucauuucuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaucuuacccagacccaauacuacuaaugaaaucagcaagaaacagcugcuggucaaaagacgcagaauacggacuauacucaauauaccaagguggaauauucgaacuaaaagaaaacgacagaauauucguaucaguaacaaacgaacacuuaauagacauggaccacgaagcaucauucuucggagcauucuuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1068 - RNA, 1000 nt, Artificial Sequence
  mRNA product Design2 comprising derived and/or modified sequence from Homo sapiens__NP_003801.1__HsALB(1-18)_HsTNFSF10(95-281) (opt13)
ggggcgcugccuacggagguggcagccaucuccuucucggcaucaagcuuaccaugaaauggguaacauucauaucacuacuauuccuauucucaucagcauacucaacaucagaagaaacaauaagcacaguacaagaaaaacaacaaaacauaucaccacucguaagagaaagaggaccacaaagaguagcagcacacauaacaggaacaagaggacgaucaaacacacuaucaucaccaaacagcaaaaacgaaaaagcacuaggaagaaaaaucaauucaugggaauccucaagaucaggacacucauuccuauccaaccuacaccuaagaaacggagaauuagucauacacgaaaaaggauucuacuacauauacucacaaacauacuucagauuccaagaagaaauaaaagaaaacaccaaaaacgacaaacaaaugguacaauacauauacaaauacacaucauacccagacccaauacuacuaaugaaaucagcaagaaacaguugcuggucaaaagacgcagaauacggacuauacucaauauaccaaggaggaauauucgaacuaaaagaaaacgacagaauauucguaucaguaacaaacgaacaccuaauagauauggaccacgaagcaucauucuucggagccuuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1069 - RNA, 1096 nt, Artificial Sequence
  mRNA product Design2 comprising derived and/or modified sequence from Homo sapiens__NP_003801.1__HsALB(1-18)_ILZ_HsTNFSF10(95-281) (opt13)
ggggcgcugccuacggagguggcagccaucuccuucucggcaucaagcuuaccaugaaauggguaacauuuauaucacuauuauuccuauucucaagcgcauacucaagaaugaaacaaauagaagacaaaauagaagaaauacuaucaaaaauauaccacauagaaaacgaaauagcacgaauaaaaaaacuaauaggagaaacaucagaagaaaccauaagcacaguacaagaaaaacaacaaaacauaagcccacuuguaagagaaagaggaccacaaagaguagcagcacacauaacaggaacaagaggaagauccaacacauuaucauccccaaacucaaaaaacgaaaaagcacuaggacgaaaaauaaacagcugggaaucaagcagaucaggacacucauuccuaagcaaccuacaccuaagaaacggagaauuaguaauacacgaaaaaggauucuacuacauauacucccaaacauacuuccgauuccaagaagaaauaaaagaaaacacaaaaaacgacaaacaaaugguacaauacauauacaaauacaccucauacccagacccaauacuacuaaugaaaagcgcaagaaacucaugcuggucaaaagacgcagaauacggacuauacucaauauaccaaggaggaauauucgaauuaaaagaaaacgaucgaauauucguaagcguaacaaacgaacaccuaauagacauggaccaugaagcaucauucuucggagcauuccucguaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1070 - RNA, 1459 nt, Artificial Sequence
  mRNA product Design2 comprising derived and/or modified sequence from Rattus norvegicus__NP_036656.1__RnCebpa (opt13)
ggggcgcugccuacggagguggcagccaucuccuucucggcaucaagcuuaccauggaaagugcggauuuuuacgaagcagaaccaagaccaccaauguccucucaucuucaaucaccaccucaugcuccaucaaaugcugcauuugguuuuccaagaggagcuggaccagcaccuccaccagcaccucccgcagcaccagaacccuuaggagguauaugcgaacaugaaacaucaauagauauaucagcauacauagauccugcagcauucaaugaugaauuuuuagcagauuuauuucaacauucaagacaacaagaaaaagcuaaagcagcugcaggaccagcagguggaggaggagauuuugacuauccaggugcaccagcaggccccggaggcgcaguaaugagcgccggagcccauggaccaccaccaggauacgguugugcugcagcaggcuauuuagacggaagacuagaaccauuauaugaacgaguaggagcuccagcauuaagaccauuaguaauuaaacaagaaccaagagaagaagaugaagcaaaacaacuagcauuagcaggacuauuuccauaucaaccacccccaccuccaccaccaccacacccacacgcauccccagcacacuuagcagcaccacauuuacaauuucaaauagcacauuguggacaaacaacuaugcauuuacaaccaggacauccaacaccaccaccaacaccuguuccuucaccacacccagcaccagcaaugggagcagcaggauuaccaggaccaggaggaucauuaaaaggauuagcuggaccacauccagaucucagaacaggaggaggaggaggaggaggagcaggagcuggaaaagcaaaaaaaucaguagauaaaaacucaaaugaauauagaguaagaagggaaagaaauaacauagcaguaagaaaaaguagagauaaagcaaaacaaagaaauguagaaacacaacaaaaaguauuagaauuaaccucagauaaugaucgauuaagaaaaagaguagaacaauuaucaagagaauuagauacauuaagagguauuuuuagacaauuaccagaaucuucacuaguaaaagcaaugggaaacugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1071 - RNA, 1417 nt, Artificial Sequence
  mRNA product Design2 comprising derived and/or modified sequence from Rattus norvegicus__NP_036656.1__RnCebpa(15-344) (opt13)
ggggcgcugccuacggagguggcagccaucuccuucucggcaucaagcuuaccaugucaagccaucuacaaaguccaccacaugcaccaucaaaugccgcauuuggguuuccaagaggagcaggaccagcaccaccaccagcaccaccagccgcuccagaaccauuaggaggaauaugugagcaugaaacaucaauagauauaucagcauauauagauccagcagcauuuaaugaugaauuucuugcagauuuauuucaacauucacgacaacaagaaaaagccaaagcagcagcaggaccagcaggaggaggcggagauuuugauuauccuggagcaccagcaggaccaggaggcgcaguaauguccgcaggagcacacggaccaccaccaggauauggaugugcagcugcaggauauuuagauggacgucuugaaccauuauaugaacgagucggagcuccagcacuaagaccacuaguaauaaaacaagaaccaagagaagaagaugaagcuaaacaacuugcacuagcaggacuauucccauaucaaccaccaccuccaccaccaccaccacacccacaugcaaguccagcccauuuagcagcaccacauuuacaauuucaaauagcccacuguggacaaacaacuaugcauuuacaaccaggacauccuacaccaccaccgacaccuguaccaucaccucauccugcaccagcuaugggagcagcaggauuaccaggaccaggaggaucacuaaaaggauuagcaggaccucauccagaucuaagaacaggagguggagggggaggaggagcaggagcagggaaagcaaaaaaaucaguagauaaaaacucaaaugaauauagaguaagaagagaaagaaauaauauagcaguaagaaaaaguagagauaaagcaaaacaacgaaauguagaaacacaacaaaaaguacuagaauuaacaagcgauaaugacagauuaagaaaaagaguagaacaauuaucaagagaauuagauacacuacgaggaaucuuuagacaacuaccagaaaguaguuuaguuaaagcuaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1072 - RNA, 1462 nt, Artificial Sequence
  mRNA product Design2 comprising derived and/or modified sequence from Mus musculus__NP_031704.2 __MmCebpa (opt13)
ggggcgcugccuacggagguggcagccaucuccuucucggcaucaagcuuaccauggaaucagcagauuuuuaugaaguugaaccuagaccaccaaugagcucacaucuacaaucaccaccacacgcaccuucuaacgcugcauuuggauuuccacgaggagcaggccccgcaccuccaccagcaccaccagcugcaccagaaccucuuggaggaauaugcgaacacgaaacaaguauagauaucucagcauauauagacccagcagcauucaaugaugaauuuuuagcagacuuauuucaacauucaagacaacaagaaaaagcaaaagcagcagcaggaccagcaggaggaggaggagacuucgauuauccuggagcucccgcagguccuggcggagcaguaaugucagccggagcacauggaccaccuccaggauauggaugugcagcagcuggauauuuagacggaagguuagaaccacuauaugaaagaguaggagcaccagcauuacgaccacuaguuauaaaacaagaaccuagagaagaagacgaagcaaaacaacuagcacuagcagguuuauuuccauaccaaccuccaccaccucccccaccaccucacccacaugcaucaccagcacacuuagcggcaccacauuuacaauuucaaauagcacauuguggacaaacaacaaugcauuuacaaccuggacauccaacaccaccaccaacaccgguaccaucaccucaugcagcaccagcacucggagcagcaggucuaccaggaccaggaucagcuuuaaaaggauuagcaggagcacauccagauuuaagaacagguggagguggaggaggaaguggugcaggagcaggcaaagcaaaaaaaucagucgauaaaaacuccaacgaauacagaguaagaagagaaagaaacaauauagcagugagaaaaaguagagacaaagcaaaacaacgaaauguagaaacacaacaaaaaguauuagaguuaacaucagauaaugaucgauuaagaaaaagaguugaacaauuaucaagagaacuagauacacuaagaggaauauuuagacaauuaccagaaucaucauuaguaaaagcaaugggaaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1073 - RNA, 1420 nt, Artificial Sequence
  mRNA product Design2 comprising derived and/or modified sequence from Mus musculus__NP_031704.2 __MmCebpa(15-359) (opt13)
ggggcgcugccuacggagguggcagccaucuccuucucggcaucaagcuuaccaugagcagucaucuacaaucaccaccacaugcaccuucaaaugcagcauuuggauuuccacgaggagcagguccagcacccccaccagcaccaccagcagcaccugaaccucuagguggaaucugugaacaugaaacaaguauagauaucucagcauauauagauccagcagcauuuaaugaugaauuuuuagcugaucuuuuucaacacucaaggcaacaagaaaaagcaaaagcagcagccggaccagcaggaggaggaggagauuuugauuaucccggagcaccagcaggaccaggcggagcaguaaugucagcuggugcacaugguccgccaccuggauaugggugugcagcagcaggauauuuagauggaagauuagaaccacuauaugaaagagucggugcaccagcauuaagaccccuaguaauaaaacaagaaccaagagaagaagacgaagcaaaacaacuagcauuagcaggccuauuuccauaucaaccaccaccaccaccacccccaccacauccacaugcaucaccagcacaucuagcagcuccacauuuacaauuccaaauagcucauuguggacaaacaacaaugcaucuacaaccuggacacccaacaccaccaccaacuccaguaccaucaccacacgcagcaccagcacuaggagcagcaggccuaccaggaccaggaagugcuuuaaaaggauuagcuggugcacauccagauuuaagaacaggagguggcggaggaggaaguggugcaggagcaggcaaagcaaagaaaagcguagauaaaaauucuaaugaauauagaguaagaagagaaaggaauaauauagcaguacgaaaaucuagagauaaagcaaaacaacgaaauguagaaacacaacaaaaaguucuagaauuaacaucagauaacgauagacuaagaaaaagagucgaacaauuaucaagggaauuagacacauuaagaggcauauucagacaacuuccagaaucaucauuagucaaagcaaugggaaauugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1074 - RNA, 1459 nt, Artificial Sequence
  mRNA product Design2 comprising derived and/or modified sequence from Homo sapiens__NP_004355.2__HsCEBPA (opt13)
ggggcgcugccuacggagguggcagccaucuccuucucggcaucaagcuuaccauggaaucugcagauuuuuaugaagcagaaccaagaccaccuauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1075 - RNA, 1417 nt, Artificial Sequence
  mRNA product Design2 comprising derived and/or modified sequence from Homo sapiens__NP_004355.2__HsCEBPA(15-358) (opt13)
ggggcgcugccuacggagguggcagccaucuccuucucggcaucaagcuuaccauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1076 - RNA, 1807 nt, Artificial Sequence
  mRNA product Design2 comprising derived and/or modified sequence from Homo sapiens__NP_000448.3__HsHNF4A (opt13)
ggggcgcugccuacggagguggcagccaucuccuucucggcaucaagcuuaccaugagacuaaguaaaacauuaguagacauggacauggccgacuauagugccgcauuagauccagcuuauacaacacuagaauuugaaaacguccaaguauuaacaaugggaaaugacacaucaccaagugaaggcaccaaucuaaaugcaccaaacucacuagguguaucagcccucugcgcaauaugcggagacagagcaacagggaaacacuacggagcaucuucaugugacggauguaaaggcuucuuuagaagaucaguaagaaaaaaccacauguacaguugcagauucagcagacaauguguagucgacaaagauaaaagaaaucaaugcagauauugcagacuaaaaaaauguuuccgagcaggaaugaaaaaagaagcaguacaaaacgaaagagaucguaucucaacaagaagaucaucauacgaagacucaagucuaccaagcauaaacgcacuucuucaagcagaaguacuaagcagacaaauaacaagcccgguaucagguaucaacggagacauaagggcaaaaaaaauagcgucaauagcagacguaugcgaaaguaugaaagaacaauuacuuguccuuguagaaugggcaaaauacauaccugcauuuugcgaauuaccacuagacgaccaaguagcacuauuaagagcacaugcaggagaacaccuucuacuaggagcuacuaaaagaucaaugguauuuaaagacguacuauuacuaggaaaugauuacauaguaccaagacacugcccagaacuugcagaaaugucacgaguaagcauaagaauccuagaugaacuugucuuaccauuccaagaauuacaaauagacgacaacgaauacgcauaucuaaaagcaauaauauuuuucgacccagacgcaaaaggacuaucagauccaggcaaaauuaaacgacuccgaucacaaguucaaguaucucuagaagacuauauaaacgaucgacaauacgauagucgaggacgauucggugaauuauuacuucuuuuaccaacauuacaaucaauaacguggcaaaugauugaacaaauccaauucauaaaauuauucggaauggcaaaaauagacaaucuauuacaagaaaugcuacuuggaggaagcccaucagacgcuccacacgcccaccacccucuacauccacaccuaaugcaagaacacaugggcacuaacguaauaguagcaaacacaaugcccacccaucuaucaaacggacaaaugugcgaauggccaagacccagaggacaagcugcaacaccagaaacaccacaaccaaguccaccaggagguaguggaagugaaccauacaaacuuuuaccaggagcaguagcaacaauaguaaaaccacuaucagcaauuccccaaccaacaauaacaaaacaagaaguaauauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1077 - RNA, 1012 nt, Artificial Sequence
  mRNA product Design2 comprising derived and/or modified sequence from Homo sapiens__NP_061986.1__HsFGF21 (opt13)
ggggcgcugccuacggagguggcagccaucuccuucucggcaucaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1078 - RNA, 1738 nt, Artificial Sequence
  mRNA product Design2 comprising derived and/or modified sequence from Homo sapiens__NP_078852.3__HsOGFRL1 (opt13)
ggggcgcugccuacggagguggcagccaucuccuucucggcaucaagcuuaccaugggaaaccuacucggcggaguuucauucagagaaccaacaacaguagaagacugcgauaguacauggcagaccgauucagaaccugaaccagaagaaccaggccccgguggaggaagcgaaggcccuggacaagaaucagaacaaccagcacaaccaccagaacaagcaggaggaagaccaggagcaagcccagcaccagacgaagacgcagaagcagcaggagccgaacaaggaggagauagcacugaagcaacagcaaaaccaaaaagaucuuuuuacgcagcacgagacuuauauaaauauagacaccaauacccaaauuucaaagacauaagauaccaaaaugaccuauccaaccuacgcuucuacaaaaauaaaauuccauucaaaccagauggaguauacauagaagaaguacuaagcaaauggaaaggugacuaugaaaaacuagaacauaaccacaccuacauacaauggcuauuuccccuaagagaacaaggauuaaauuucuacgcaaaagaacuuacaaccuacgaaauagaagaauuuaaaaaaaccaaagaagccauaagaagauucuuauuagcauacaagaugauguuagaauuuuucggaauuaaacucacagacaaaacaggcaacguagcacgagccguaaacuggcaagaacgauuccaacacuuaaacgaaagucagcacaacuaccuaagaauaacaagaauauuaaaaaguuuaggagaacuaggcuacgaaucauucaaaucuccacuuguaaaauucauacuacacgaagccuuagucgaaaacacaauaccaaacauaaaacaaucugcacuagaauacuuuguauacacaauaagagacagaagagaaaggagaaaauuacuacgauucgcucaaaaacacuauacaccaucagaaaauuucauauggggccccccaagaaaagaacaaagcgaaggcucaaaagcacaaaaaaugucaaguccacuagcaucaagccauaacucacaaacuucaaugcacaaaaaagccaaagacucaaagaacucaucaucagccguacaccuaaacagcaaaacagcagaagauaaaaaaguugcaccaaaagaaccaguagaagaaacagauagaccaucaccagaaccaucaaacgaagcggcaaaaccaagaaacacugagaaagauagcaacgcagaaaacaugaacagccaaccagaaaaaacaguaacgacaccaacugaaaaaaaagaaucaguaaguccagaaaauaaugaagaaggcggcaacgauaaccaagacaacgaaaauccaggaaauaccaacugccacgacguaguauuaguacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1079 - RNA, 940 nt, Artificial Sequence
  mRNA product Design2 comprising derived and/or modified sequence from Homo sapiens__NP_008842.1__HsRLN1 (opt13)
ggggcgcugccuacggagguggcagccaucuccuucucggcaucaagcuuaccaugccaagacuauucuuauuccaccuacuagaauuuugcuuacuacuaaaccaauucucaagagcaguagcagcaaaauggaaagacgacguaauaaaacuaugcggaagagaacuuguaagagcacaaauagcaauaugcggaaugucaacauggucaaaaagaucacuaucacaagaagacgccccacaaacaccaagaccaguagcagaaauaguaccaucauucauaaacaaagacacagaaacaauaauaauaaugcuagaauuuauagcaaaccuaccaccagaauuaaaagcagcauuaucagaaagacaaccaucauuaccagaacuacaacaauacguaccagcacuaaaagacucaaaccuaucauucgaagaauuuaaaaaacuaauaagaaacagacaaucagaagcagcagacucaaacccaucagaacuaaaauaccuaggacuagacacacacucacaaaaaaaacgaagaccauacguagcacuauuugaaaaaugcugcuuaauaggaugcacaaaaagaucacuagcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1080 - RNA, 940 nt, Artificial Sequence
  mRNA product Design2 comprising derived and/or modified sequence from Homo sapiens__NP_604390.1__HsRLN2 (opt13)
ggggcgcugccuacggagguggcagccaucuccuucucggcaucaagcuuaccaugccaagacuauucuuuuuccaccuacuaggcguaugccuccuacuaaaccaauuuucaagagcaguagcagacucauggauggaagaaguaauaaaacuaugcggaagagaacuuguaagagcacaaauagcaauaugcggaaugucaacauggucaaaaagaucauuaucacaagaagacgcaccacaaacaccaagaccaguagcagaaauaguaccaucauucauaaacaaagacacagaaacaaucaauaugaugucagaauuuguagcaaaccucccacaagaacuaaaacuaacacuaucagaaaugcaaccagcacuaccacaauuacaacaacacgucccaguacucaaagacucaucacuauuauucgaagaauuuaaaaaauuaauaagaaacagacaaucagaagcagcagacagcucacccucagaacuaaaauaccuaggacuagacacacacucaagaaaaaaaagacaacuauacucagcacuagccaacaaaugcugccacguaggaugcacaaaaagaucacuagcaagauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1081 - RNA, 811 nt, Artificial Sequence
  mRNA product Design2 comprising derived and/or modified sequence from Homo sapiens__NP_543140.1__HsRLN3  (opt13)
ggggcgcugccuacggagguggcagccaucuccuucucggcaucaagcuuaccauggcaagauauauguuauuauuauuauuagcaguauggguauuaacaggagaauuauggccaggagcagaagcaagagcagcaccauauggaguaagauuauguggaagagaauuuauaagagcaguaauauuuacauguggaggaaguagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaagcauuuuauagaggaagaccaaguuggcaaggaacaccaggaguauuaagaggaaguagagauguauuagcaggauuaaguucaaguuguuguaaauggggauguucaaaaucagaaauaaguucauuauguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1082 - RNA, 1792 nt, Artificial Sequence
  mRNA product Design2 comprising derived and/or modified sequence from Homo sapiens__NP_002412.1__HsMMP1 (opt13) R4749
ggggcgcugccuacggagguggcagccaucuccuucucggcaucaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1083 - RNA, 1552 nt, Artificial Sequence
  mRNA product Design2 comprising derived and/or modified sequence from Homo sapiens__NP_002412.1__HsMMP1(1-19,100-469) (opt13) R4751
ggggcgcugccuacggagguggcagccaucuccuucucggcaucaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1084 - RNA, 3739 nt, Artificial Sequence
  mRNA product Design2 comprising derived and/or modified sequence from Clostridium histolyticum__BAA77453.1__ColG (opt13)
ggggcgcugccuacggagguggcagccaucuccuucucggcaucaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1085 - RNA, 3463 nt, Artificial Sequence
  mRNA product Design2 comprising derived and/or modified sequence from Clostridium histolyticum__BAA77453.1__HsALB(1-18)_ColG(111-1118) (opt13)
ggggcgcugccuacggagguggcagccaucuccuucucggcaucaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1086 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt13)
ggggcgcugccuacggagguggcagccaucuccuucucggcaucaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1087 - RNA, 3487 nt, Artificial Sequence
  mRNA product Design2 comprising derived and/or modified sequence from Clostridium histolyticum__BAA34542.1__ColH (opt13)
ggggcgcugccuacggagguggcagccaucuccuucucggcaucaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1088 - RNA, 3448 nt, Artificial Sequence
  mRNA product Design2 comprising derived and/or modified sequence from Clostridium histolyticum__BAA34542.1__ColH (opt13)
ggggcgcugccuacggagguggcagccaucuccuucucggcaucaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1089 - RNA, 3382 nt, Artificial Sequence
  mRNA product Design2 comprising derived and/or modified sequence from Clostridium histolyticum__BAA34542.1__HsALB(1-18)_ColH(41-1021) (opt13)
ggggcgcugccuacggagguggcagccaucuccuucucggcaucaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1090 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt13)
ggggcgcugccuacggagguggcagccaucuccuucucggcaucaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1091 - RNA, 1193 nt, Artificial Sequence
  mRNA product Design3 comprising derived and/or modified sequence from Homo sapiens__NP_003801.1__HsTNFSF10  (wt)
gggagagucccgcagucggcguccagcggcucugcuuguucgugugugugucguugcaggccuuauucaagcuuaccauggcuaugauggagguccaggggggacccagccugggacagaccugcgugcugaucgugaucuucacagugcuccugcagucucucuguguggcuguaacuuacguguacuuuaccaacgagcugaagcagaugcaggacaaguacuccaaaaguggcauugcuuguuucuuaaaagaagaugacaguuauugggaccccaaugacgaagagaguaugaacagccccugcuggcaagucaaguggcaacuccgucagcucguuagaaagaugauuuugagaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1092 - RNA, 914 nt, Artificial Sequence
  mRNA product Design3 comprising derived and/or modified sequence from Homo sapiens__NP_003801.1__HsTNFSF10(95-281) (wt)
gggagagucccgcagucggcguccagcggcucugcuuguucgugugugugucguugcaggccuuauucaagcuuaccaugaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1093 - RNA, 965 nt, Artificial Sequence
  mRNA product Design3 comprising derived and/or modified sequence from Homo sapiens__NP_003801.1__HsALB(1-18)_HsTNFSF10(95-281) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1094 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccagaaugaagcagaucgaggacaaaauugaagagauccugagcaagauuuaccacaucgaaaacgagauugccaggaucaaaaagcucauuggcgaaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1095 - RNA, 1424 nt, Artificial Sequence
  mRNA product Design3 comprising derived and/or modified sequence from Rattus norvegicus__NP_036656.1__RnCebpa (wt) R5120
gggagagucccgcagucggcguccagcggcucugcuuguucgugugugugucguugcaggccuuauucaagcuuaccauggagucggccgacuucuacgaggcggagccgcggcccccgaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1096 - RNA, 1382 nt, Artificial Sequence
  mRNA product Design3 comprising derived and/or modified sequence from Rattus norvegicus__NP_036656.1__RnCebpa(15-344) (wt) R5121
gggagagucccgcagucggcguccagcggcucugcuuguucgugugugugucguugcaggccuuauucaagcuuaccaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1097 - RNA, 1427 nt, Artificial Sequence
  mRNA product Design3 comprising derived and/or modified sequence from Mus musculus__NP_031704.2 __MmCebpa (wt)
gggagagucccgcagucggcguccagcggcucugcuuguucgugugugugucguugcaggccuuauucaagcuuaccauggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1098 - RNA, 1385 nt, Artificial Sequence
  mRNA product Design3 comprising derived and/or modified sequence from Mus musculus__NP_031704.2 __MmCebpa(15-359) (wt)
gggagagucccgcagucggcguccagcggcucugcuuguucgugugugugucguugcaggccuuauucaagcuuaccaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1099 - RNA, 1424 nt, Artificial Sequence
  mRNA product Design3 comprising derived and/or modified sequence from Homo sapiens__NP_004355.2__HsCEBPA (wt)
gggagagucccgcagucggcguccagcggcucugcuuguucgugugugugucguugcaggccuuauucaagcuuaccauggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1100 - RNA, 1382 nt, Artificial Sequence
  mRNA product Design3 comprising derived and/or modified sequence from Homo sapiens__NP_004355.2__HsCEBPA (wt)
gggagagucccgcagucggcguccagcggcucugcuuguucgugugugugucguugcaggccuuauucaagcuuaccaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1101 - RNA, 1424 nt, Artificial Sequence
  mRNA product Design3 comprising derived and/or modified sequence from Homo sapiens__NP_004355.2__HsCEBPA(15-358) (wt)
gggagagucccgcagucggcguccagcggcucugcuuguucgugugugugucguugcaggccuuauucaagcuuaccauggagucggccgacuucuacgaggcggagccgcggcccccgaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1102 - RNA, 1382 nt, Artificial Sequence
  mRNA product Design3 comprising derived and/or modified sequence from Homo sapiens__NP_004355.2__HsCEBPA(15-358) (wt)
gggagagucccgcagucggcguccagcggcucugcuuguucgugugugugucguugcaggccuuauucaagcuuaccaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1103 - RNA, 1772 nt, Artificial Sequence
  mRNA product Design3 comprising derived and/or modified sequence from Homo sapiens__NP_000448.3__HsHNF4A (wt)
gggagagucccgcagucggcguccagcggcucugcuuguucgugugugugucguugcaggccuuauucaagcuuaccaugcgacucuccaaaacccucgucgacauggacauggccgacuacagugcugcacuggacccagccuacaccacccuggaauuugagaaugugcagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccugcugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1104 - RNA, 1772 nt, Artificial Sequence
  mRNA product Design3 comprising derived and/or modified sequence from Homo sapiens__NP_000448.3__HsHNF4A (wt)
gggagagucccgcagucggcguccagcggcucugcuuguucgugugugugucguugcaggccuuauucaagcuuaccaugcgacucuccaaaacccucgucgacauggacauggccgacuacagugcugcacuggacccagccuacaccacccuggaauuugagaauguccagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccuccugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccagguccaggugagcuuggaggacuacaucaacgaccgccaguaugacucgcguggccgcuuuggagagcugcugcugcugcugcccaccuugcagagcaucaccuggcagaugaucgagcagauccaguucaucaagcuguucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1105 - RNA, 977 nt, Artificial Sequence
  mRNA product Design3 comprising derived and/or modified sequence from Homo sapiens__NP_061986.1__HsFGF21 (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1106 - RNA, 977 nt, Artificial Sequence
  mRNA product Design3 comprising derived and/or modified sequence from Homo sapiens__NP_061986.1__HsFGF21 (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1107 - RNA, 1703 nt, Artificial Sequence
  mRNA product Design3 comprising derived and/or modified sequence from Homo sapiens__NP_078852.3__HsOGFRL1 (wt)
gggagagucccgcagucggcguccagcggcucugcuuguucgugugugugucguugcaggccuuauucaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaauucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaauucucaaccugagaaaacaguuacuacucccacagaaaaaaaggagaguguaucuccugagaauaacgaagaagguggaaaugauaaccaagacaaugaaaauccuggaaauacaaauugccaugauguuguacuaguacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1108 - RNA, 1703 nt, Artificial Sequence
  mRNA product Design3 comprising derived and/or modified sequence from Homo sapiens__NP_078852.3__HsOGFRL1 (wt)
gggagagucccgcagucggcguccagcggcucugcuuguucgugugugugucguugcaggccuuauucaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaguucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaacucucaaccugagaaaacaguuacuacucccacagaaaaaaaggagaguguaucuccugagaauaacgaagaagguggaaaugauaaccaagacaaugaaaauccuggaaauacaaauugccaugauguuguacuuguacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1109 - RNA, 905 nt, Artificial Sequence
  mRNA product Design3 comprising derived and/or modified sequence from Homo sapiens__NP_008842.1__HsRLN1 (wt)
gggagagucccgcagucggcguccagcggcucugcuuguucgugugugugucguugcaggccuuauucaagcuuaccaugccucgccuguucuuguuccaccugcuagaauucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaauucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1110 - RNA, 905 nt, Artificial Sequence
  mRNA product Design3 comprising derived and/or modified sequence from Homo sapiens__NP_008842.1__HsRLN1 (wt)
gggagagucccgcagucggcguccagcggcucugcuuguucgugugugugucguugcaggccuuauucaagcuuaccaugccucgccuguucuuguuccaccuccuagaguucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaguucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1111 - RNA, 905 nt, Artificial Sequence
  mRNA product Design3 comprising derived and/or modified sequence from Homo sapiens__NP_604390.1__HsRLN2 (wt)
gggagagucccgcagucggcguccagcggcucugcuuguucgugugugugucguugcaggccuuauucaagcuuaccaugccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1112 - RNA, 776 nt, Artificial Sequence
  mRNA product Design3 comprising derived and/or modified sequence from Homo sapiens__NP_543140.1__HsRLN3  (wt)
gggagagucccgcagucggcguccagcggcucugcuuguucgugugugugucguugcaggccuuauucaagcuuaccauggccagguacaugcugcugcugcuccuggcgguaugggugcugaccggggagcuguggccgggagcugaggcccgggcagcgccuuacggggucaggcuuugcggccgagaauucauccgagcagucaucuucaccugcgggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1113 - RNA, 776 nt, Artificial Sequence
  mRNA product Design3 comprising derived and/or modified sequence from Homo sapiens__NP_543140.1__HsRLN3  (wt)
gggagagucccgcagucggcguccagcggcucugcuuguucgugugugugucguugcaggccuuauucaagcuuaccauggccagguacaugcugcugcugcuccuggcgguaugggugcugaccggggagcuguggccgggagcugaggcccgggcagcgccuuacggggucaggcuuugcggccgagaguucauccgagcagucaucuucaccugugggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1114 - RNA, 1757 nt, Artificial Sequence
  mRNA product Design3 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1115 - RNA, 1757 nt, Artificial Sequence
  mRNA product Design3 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1116 - RNA, 1517 nt, Artificial Sequence
  mRNA product Design3 comprising derived and/or modified sequence from Homo sapiens__NP_002412.1__HsMMP1(1-19,100-469) (wt)
gggagagucccgcagucggcguccagcggcucugcuuguucgugugugugucguugcaggccuuauucaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1117 - RNA, 3704 nt, Artificial Sequence
  mRNA product Design3 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1118 - RNA, 3704 nt, Artificial Sequence
  mRNA product Design3 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1119 - RNA, 3428 nt, Artificial Sequence
  mRNA product Design3 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1120 - RNA, 3428 nt, Artificial Sequence
  mRNA product Design3 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1121 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1122 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1123 - RNA, 3452 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1124 - RNA, 3452 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1125 - RNA, 3413 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1126 - RNA, 3413 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1127 - RNA, 3347 nt, Artificial Sequence
  mRNA product Design3 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1128 - RNA, 3347 nt, Artificial Sequence
  mRNA product Design3 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1129 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1130 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1131 - RNA, 1193 nt, Artificial Sequence
  mRNA product Design3 comprising derived and/or modified sequence from Homo sapiens__NP_003801.1__HsTNFSF10 (opt1) R5122
gggagagucccgcagucggcguccagcggcucugcuuguucgugugugugucguugcaggccuuauucaagcuuaccauggccaugauggaggugcagggcgggcccagccugggccagaccugcguccucaucgugaucuucaccgugcugcugcagucccucugcgucgccgugacguacguguacuucaccaacgagcugaagcagaugcaggacaaguacagcaaguccgggaucgcgugcuuccugaaggaggacgacagcuacugggacccgaacgacgaggaguccaugaacagcccgugcuggcaggucaaguggcagcuccgccagcuggugcggaagaugauccugcgcaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1132 - RNA, 914 nt, Artificial Sequence
  mRNA product Design3 comprising derived and/or modified sequence from Homo sapiens__NP_003801.1__HsTNFSF10(95-281) (opt1)
gggagagucccgcagucggcguccagcggcucugcuuguucgugugugugucguugcaggccuuauucaagcuuaccaugaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1133 - RNA, 965 nt, Artificial Sequence
  mRNA product Design3 comprising derived and/or modified sequence from Homo sapiens__NP_003801.1__HsALB(1-18)_HsTNFSF10(95-281) (opt1) R5123
gggagagucccgcagucggcguccagcggcucugcuuguucgugugugugucguugcaggccuuauucaagcuuaccaugaagugggugaccuucaucagccugcucuuccuguucuccagcgccuacuccaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1134 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt1) R5124
gggagagucccgcagucggcguccagcggcucugcuuguucgugugugugucguugcaggccuuauucaagcuuaccaugaagugggugaccuucaucagccugcucuuccuguucuccagcgccuacucccgcaugaagcagaucgaggacaagaucgaggagauccugagcaagaucuaccacaucgagaacgagaucgcccggaucaagaagcucaucggcgagaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1135 - RNA, 1424 nt, Artificial Sequence
  mRNA product Design3 comprising derived and/or modified sequence from Rattus norvegicus__NP_036656.1__RnCebpa (opt1)
gggagagucccgcagucggcguccagcggcucugcuuguucgugugugugucguugcaggccuuauucaagcuuaccauggagagcgccgacuucuacgaggccgagccccgcccgcccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1136 - RNA, 1382 nt, Artificial Sequence
  mRNA product Design3 comprising derived and/or modified sequence from Rattus norvegicus__NP_036656.1__RnCebpa(15-344) (opt1)
gggagagucccgcagucggcguccagcggcucugcuuguucgugugugugucguugcaggccuuauucaagcuuaccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1137 - RNA, 1427 nt, Artificial Sequence
  mRNA product Design3 comprising derived and/or modified sequence from Mus musculus__NP_031704.2 __MmCebpa (opt1)
gggagagucccgcagucggcguccagcggcucugcuuguucgugugugugucguugcaggccuuauucaagcuuaccauggagagcgccgacuucuacgagguggagccccgcccgcccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1138 - RNA, 1385 nt, Artificial Sequence
  mRNA product Design3 comprising derived and/or modified sequence from Mus musculus__NP_031704.2 __MmCebpa(15-359) (opt1)
gggagagucccgcagucggcguccagcggcucugcuuguucgugugugugucguugcaggccuuauucaagcuuaccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1139 - RNA, 1424 nt, Artificial Sequence
  mRNA product Design3 comprising derived and/or modified sequence from Homo sapiens__NP_004355.2__HsCEBPA (opt1)
gggagagucccgcagucggcguccagcggcucugcuuguucgugugugugucguugcaggccuuauucaagcuuaccauggagagcgccgacuucuacgaggccgagccccgcccgcccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1140 - RNA, 1382 nt, Artificial Sequence
  mRNA product Design3 comprising derived and/or modified sequence from Homo sapiens__NP_004355.2__HsCEBPA(15-358) (opt1)
gggagagucccgcagucggcguccagcggcucugcuuguucgugugugugucguugcaggccuuauucaagcuuaccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1141 - RNA, 1772 nt, Artificial Sequence
  mRNA product Design3 comprising derived and/or modified sequence from Homo sapiens__NP_000448.3__HsHNF4A (opt1)
gggagagucccgcagucggcguccagcggcucugcuuguucgugugugugucguugcaggccuuauucaagcuuaccaugcgccugagcaagacccucguggacauggacauggccgacuacuccgccgcgcuggaccccgccuacaccacgcuggaguucgagaacguccaggugcucaccaugggcaacgacaccagcccguccgaggggaccaaccugaacgcccccaacagccugggcguguccgcccucugcgccaucugcggggaccgggcgacgggcaagcacuacggggccagcuccugcgacggcugcaagggcuucuuccgccggagcguccgcaagaaccacauguacuccugccgguucagccgccagugcgugguggacaaggacaagcggaaccagugccgcuacugccggcugaagaagugcuuccgcgccgggaugaagaaggaggccguccagaacgagcgggaccgcaucuccacccggcgcagcuccuacgaggacagcucccugcccagcaucaacgcgcuccugcaggccgaggugcugucccggcagaucaccagccccguguccggcaucaacggggacauccgcgccaagaagaucgccagcaucgccgacgucugcgagagcaugaaggagcagcuccuggugcugguggagugggcgaaguacaucccggccuucugcgagcucccccuggacgaccaggucgcccugcuccgggcccacgccggcgagcaccuccugcugggggcgaccaagcgcuccaugguguucaaggacgugcugcugcucggcaacgacuacaucgucccccggcacugccccgagcuggccgagaugagccgcguguccauccggauccuggacgagcucgugcugccguuccaggagcugcagaucgacgacaacgaguacgccuaccucaaggccaucaucuucuucgaccccgacgccaagggccugagcgaccccgggaagaucaagcgccugcgcucccagguccaggugagccucgaggacuacaucaacgaccggcaguacgacucccgcggccgguucggggagcugcugcuccugcugcccacgcuccagagcaucaccuggcagaugaucgagcagauccaguucaucaagcuguucggcauggcgaagaucgacaaccugcuccaggagaugcugcugggcggguccccgagcgacgcgccccacgcccaccacccccuccacccccaccugaugcaggagcacaugggcaccaacgugaucgucgccaacaccaugccgacgcaccuguccaacgggcagaugugcgaguggccccgcccccggggccaggccgccacccccgagaccccgcagcccagcccgcccgggggcuccggcagcgagcccuacaagcuccugcccggggccguggccaccaucgugaagccccuguccgccaucccccagccgacgaucaccaagcaggaggucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1142 - RNA, 977 nt, Artificial Sequence
  mRNA product Design3 comprising derived and/or modified sequence from Homo sapiens__NP_061986.1__HsFGF21 (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1143 - RNA, 1703 nt, Artificial Sequence
  mRNA product Design3 comprising derived and/or modified sequence from Homo sapiens__NP_078852.3__HsOGFRL1 (opt1)
gggagagucccgcagucggcguccagcggcucugcuuguucgugugugugucguugcaggccuuauucaagcuuaccaugggcaaccugcucgggggcgugagcuuccgcgagcccaccaccgucgaggacugcgacuccacguggcagaccgacagcgagccggagcccgaggagcccgggcccggcgggggcuccgagggcccggggcaggagagcgagcagcccgcccagccgcccgagcaggccggcgggcggcccggcgcgucccccgcccccgacgaggacgccgaggccgccggggcggagcagggcggcgacagcaccgaggccaccgccaagcccaagcgcuccuucuacgccgcgcgggaccuguacaaguaccgccaccaguacccgaacuucaaggacauccgguaccagaacgaccugagcaaccuccgcuucuacaagaacaagauccccuucaagcccgacgggguguacaucgaggaggugcuguccaaguggaagggcgacuacgagaagcuggagcacaaccacacguacauccaguggcuguucccccuccgggagcaggggcugaacuucuacgccaaggagcucaccaccuacgagaucgaggaguucaagaagaccaaggaggccauccgccgguuccugcuggccuacaagaugaugcucgaguucuucggcaucaagcugacggacaagaccggcaacgucgcccgcgcggugaacuggcaggagcgguuccagcaccugaacgagagccagcacaacuaccuccgcaucacccggauccugaagucccugggggagcucggcuacgagagcuucaaguccccgcuggugaaguucauccugcacgaggcccucgucgagaacaccauccccaacaucaagcagagcgcccuggaguacuucguguacacgauccgcgaccggcgcgagcggcgcaagcugcuccgguucgcccagaagcacuacacccccuccgagaacuucaucugggggcccccgcgcaaggagcagagcgagggcuccaaggcccagaagaugagcagcccccuggcguccagccacaacucccagaccagcaugcacaagaaggccaaggacuccaagaacagcuccagcgccgugcaccugaacuccaagaccgccgaggacaagaaggucgcccccaaggagcccguggaggagacggaccggccgagccccgagcccuccaacgaggcggccaagccccgcaacaccgagaaggacagcaacgccgagaacaugaacucccagccggagaagaccgugaccacgcccaccgagaagaaggagagcgucucccccgagaacaacgaggagggcgggaacgacaaccaggacaacgagaacccgggcaacaccaacugccacgacguggugcucguccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1144 - RNA, 905 nt, Artificial Sequence
  mRNA product Design3 comprising derived and/or modified sequence from Homo sapiens__NP_008842.1__HsRLN1 (opt1)
gggagagucccgcagucggcguccagcggcucugcuuguucgugugugugucguugcaggccuuauucaagcuuaccaugccccgccuguuccucuuccaccuccuggaguucugccugcugcugaaccaguucagccgggccguggccgcgaaguggaaggacgacgucaucaagcucugcggccgcgagcuggugcgggcccagaucgccaucugcgggauguccaccuggagcaagcgcucccugagccaggaggacgccccgcagacgccccggcccguggccgagaucguccccuccuucaucaacaaggacaccgagaccaucaucaucaugcucgaguucaucgcgaaccugccgcccgagcugaaggccgcccucagcgagcgccagcccucccugcccgagcugcagcaguacgugccggcccucaaggacagcaaccuguccuucgaggaguucaagaagcugauccggaaccgccagagcgaggcggccgacuccaaccccagcgagcucaaguaccugggccuggacacccacucccagaagaagcggcgccccuacguggcccucuucgagaagugcugccugaucgggugcaccaagcggagccuggccaaguacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1145 - RNA, 905 nt, Artificial Sequence
  mRNA product Design3 comprising derived and/or modified sequence from Homo sapiens__NP_604390.1__HsRLN2 (opt1)
gggagagucccgcagucggcguccagcggcucugcuuguucgugugugugucguugcaggccuuauucaagcuuaccaugccccgccuguucuucuuccaccuccugggcgugugccugcuccugaaccaguucagccgggccgucgccgacuccuggauggaggaggugaucaagcugugcgggcgcgagcucgugcgggcgcagaucgccaucugcggcaugagcaccugguccaagcgcagccugucccaggaggacgccccgcagacgccccggcccgucgccgagaucgugcccagcuucaucaacaaggacaccgagaccaucaacaugauguccgaguucguggccaaccugccgcaggagcucaagcugacccugagcgagaugcagcccgcgcucccccagcugcagcagcacguccccgugcugaaggacuccagccuccuguucgaggaguucaagaagcugauccgcaaccggcaguccgaggccgccgacagcuccccgagcgagcucaaguaccuggggcuggacacccacucccgcaagaagcggcagcucuacagcgcccuggcgaacaagugcugccacgugggcugcacgaagcgcucccuggcccgguucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1146 - RNA, 776 nt, Artificial Sequence
  mRNA product Design3 comprising derived and/or modified sequence from Homo sapiens__NP_543140.1__HsRLN3  (opt1)
gggagagucccgcagucggcguccagcggcucugcuuguucgugugugugucguugcaggccuuauucaagcuuaccauggcccgcuacaugcugcuccugcugcucgccguguggguccugaccggcgagcuguggcccggggcggaggcccgggccgccccguacggcgugcgccucugcgggcgggaguucauccgcgccgugaucuucacgugcggcgggagccgguggcgccgguccgacauccuggcgcacgaggccaugggcgacaccuuccccgacgccgacgccgacgaggacagccuggcgggcgagcucgacgaggccaugggguccagcgaguggcuggcccugaccaagagcccccaggccuucuaccgcggccggcccuccuggcaggggaccccgggcguccuccgcgggucccgggacgugcuggccggccugagcuccagcugcugcaaguggggcugcuccaagagcgagaucuccagccucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1147 - RNA, 1757 nt, Artificial Sequence
  mRNA product Design3 comprising derived and/or modified sequence from Homo sapiens__NP_002412.1__HsMMP1 (opt1)
gggagagucccgcagucggcguccagcggcucugcuuguucgugugugugucguugcaggccuuauucaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1148 - RNA, 1517 nt, Artificial Sequence
  mRNA product Design3 comprising derived and/or modified sequence from Homo sapiens__NP_002412.1__HsMMP1(1-19,100-469) (opt1)
gggagagucccgcagucggcguccagcggcucugcuuguucgugugugugucguugcaggccuuauucaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1149 - RNA, 3704 nt, Artificial Sequence
  mRNA product Design3 comprising derived and/or modified sequence from Clostridium histolyticum__BAA77453.1__ColG (opt1)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1150 - RNA, 3428 nt, Artificial Sequence
  mRNA product Design3 comprising derived and/or modified sequence from Clostridium histolyticum__BAA77453.1__HsALB(1-18)_ColG(111-1118) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1151 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1152 - RNA, 3452 nt, Artificial Sequence
  mRNA product Design3 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1153 - RNA, 3413 nt, Artificial Sequence
  mRNA product Design3 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1154 - RNA, 3347 nt, Artificial Sequence
  mRNA product Design3 comprising derived and/or modified sequence from Clostridium histolyticum__BAA34542.1__HsALB(1-18)_ColH(41-1021) (opt1)
gggagagucccgcagucggcguccagcggcucugcuuguucgugugugugucguugcaggccuuauucaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1155 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1156 - RNA, 1193 nt, Artificial Sequence
  mRNA product Design3 comprising derived and/or modified sequence from Homo sapiens__NP_003801.1__HsTNFSF10 (opt2)
gggagagucccgcagucggcguccagcggcucugcuuguucgugugugugucguugcaggccuuauucaagcuuaccauggccaugauggagguccagggcggccccucccucggccagaccugcguccucaucgucaucuucaccguccuccuccagucccucugcgucgccgucaccuacgucuacuucaccaacgagcucaagcagaugcaggacaaguacuccaaguccggcaucgccugcuuccucaaggaggacgacuccuacugggaccccaacgacgaggaguccaugaacucccccugcuggcaggucaaguggcagcuccgccagcucguccgcaagaugauccuccgcaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1157 - RNA, 914 nt, Artificial Sequence
  mRNA product Design3 comprising derived and/or modified sequence from Homo sapiens__NP_003801.1__HsTNFSF10(95-281) (opt2)
gggagagucccgcagucggcguccagcggcucugcuuguucgugugugugucguugcaggccuuauucaagcuuaccaugaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1158 - RNA, 965 nt, Artificial Sequence
  mRNA product Design3 comprising derived and/or modified sequence from Homo sapiens__NP_003801.1__HsALB(1-18)_HsTNFSF10(95-281) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1159 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt2)
gggagagucccgcagucggcguccagcggcucugcuuguucgugugugugucguugcaggccuuauucaagcuuaccaugaagugggucaccuucaucucccuccucuuccucuucuccuccgccuacucccgcaugaagcagaucgaggacaagaucgaggagauccucuccaagaucuaccacaucgagaacgagaucgcccgcaucaagaagcucaucggcgagaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1160 - RNA, 1424 nt, Artificial Sequence
  mRNA product Design3 comprising derived and/or modified sequence from Rattus norvegicus__NP_036656.1__RnCebpa (opt2)
gggagagucccgcagucggcguccagcggcucugcuuguucgugugugugucguugcaggccuuauucaagcuuaccauggaguccgccgacuucuacgaggccgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1161 - RNA, 1382 nt, Artificial Sequence
  mRNA product Design3 comprising derived and/or modified sequence from Rattus norvegicus__NP_036656.1__RnCebpa(15-344) (opt2)
gggagagucccgcagucggcguccagcggcucugcuuguucgugugugugucguugcaggccuuauucaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1162 - RNA, 1427 nt, Artificial Sequence
  mRNA product Design3 comprising derived and/or modified sequence from Mus musculus__NP_031704.2 __MmCebpa (opt2)
gggagagucccgcagucggcguccagcggcucugcuuguucgugugugugucguugcaggccuuauucaagcuuaccauggaguccgccgacuucuacgaggucgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1163 - RNA, 1385 nt, Artificial Sequence
  mRNA product Design3 comprising derived and/or modified sequence from Mus musculus__NP_031704.2 __MmCebpa(15-359) (opt2)
gggagagucccgcagucggcguccagcggcucugcuuguucgugugugugucguugcaggccuuauucaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1164 - RNA, 1424 nt, Artificial Sequence
  mRNA product Design3 comprising derived and/or modified sequence from Homo sapiens__NP_004355.2__HsCEBPA (opt2)
gggagagucccgcagucggcguccagcggcucugcuuguucgugugugugucguugcaggccuuauucaagcuuaccauggaguccgccgacuucuacgaggccgagccccgcccccccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1165 - RNA, 1382 nt, Artificial Sequence
  mRNA product Design3 comprising derived and/or modified sequence from Homo sapiens__NP_004355.2__HsCEBPA(15-358) (opt2)
gggagagucccgcagucggcguccagcggcucugcuuguucgugugugugucguugcaggccuuauucaagcuuaccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1166 - RNA, 1772 nt, Artificial Sequence
  mRNA product Design3 comprising derived and/or modified sequence from Homo sapiens__NP_000448.3__HsHNF4A (opt2)
gggagagucccgcagucggcguccagcggcucugcuuguucgugugugugucguugcaggccuuauucaagcuuaccaugcgccucuccaagacccucgucgacauggacauggccgacuacuccgccgcccucgaccccgccuacaccacccucgaguucgagaacguccagguccucaccaugggcaacgacaccucccccuccgagggcaccaaccucaacgcccccaacucccucggcgucuccgcccucugcgccaucugcggcgaccgcgccaccggcaagcacuacggcgccuccuccugcgacggcugcaagggcuucuuccgccgcuccguccgcaagaaccacauguacuccugccgcuucucccgccagugcgucgucgacaaggacaagcgcaaccagugccgcuacugccgccucaagaagugcuuccgcgccggcaugaagaaggaggccguccagaacgagcgcgaccgcaucuccacccgccgcuccuccuacgaggacuccucccuccccuccaucaacgcccuccuccaggccgagguccucucccgccagaucaccucccccgucuccggcaucaacggcgacauccgcgccaagaagaucgccuccaucgccgacgucugcgaguccaugaaggagcagcuccucguccucgucgagugggccaaguacauccccgccuucugcgagcucccccucgacgaccaggucgcccuccuccgcgcccacgccggcgagcaccuccuccucggcgccaccaagcgcuccauggucuucaaggacguccuccuccucggcaacgacuacaucgucccccgccacugccccgagcucgccgagaugucccgcgucuccauccgcauccucgacgagcucguccuccccuuccaggagcuccagaucgacgacaacgaguacgccuaccucaaggccaucaucuucuucgaccccgacgccaagggccucuccgaccccggcaagaucaagcgccuccgcucccagguccaggucucccucgaggacuacaucaacgaccgccaguacgacucccgcggccgcuucggcgagcuccuccuccuccuccccacccuccaguccaucaccuggcagaugaucgagcagauccaguucaucaagcucuucggcauggccaagaucgacaaccuccuccaggagaugcuccucggcggcucccccuccgacgccccccacgcccaccacccccuccacccccaccucaugcaggagcacaugggcaccaacgucaucgucgccaacaccaugcccacccaccucuccaacggccagaugugcgaguggccccgcccccgcggccaggccgccacccccgagaccccccagcccuccccccccggcggcuccggcuccgagcccuacaagcuccuccccggcgccgucgccaccaucgucaagccccucuccgccaucccccagcccaccaucaccaagcaggaggucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1167 - RNA, 977 nt, Artificial Sequence
  mRNA product Design3 comprising derived and/or modified sequence from Homo sapiens__NP_061986.1__HsFGF21 (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1168 - RNA, 1703 nt, Artificial Sequence
  mRNA product Design3 comprising derived and/or modified sequence from Homo sapiens__NP_078852.3__HsOGFRL1 (opt2)
gggagagucccgcagucggcguccagcggcucugcuuguucgugugugugucguugcaggccuuauucaagcuuaccaugggcaaccuccucggcggcgucuccuuccgcgagcccaccaccgucgaggacugcgacuccaccuggcagaccgacuccgagcccgagcccgaggagcccggccccggcggcggcuccgagggccccggccaggaguccgagcagcccgcccagccccccgagcaggccggcggccgccccggcgccucccccgcccccgacgaggacgccgaggccgccggcgccgagcagggcggcgacuccaccgaggccaccgccaagcccaagcgcuccuucuacgccgcccgcgaccucuacaaguaccgccaccaguaccccaacuucaaggacauccgcuaccagaacgaccucuccaaccuccgcuucuacaagaacaagauccccuucaagcccgacggcgucuacaucgaggagguccucuccaaguggaagggcgacuacgagaagcucgagcacaaccacaccuacauccaguggcucuucccccuccgcgagcagggccucaacuucuacgccaaggagcucaccaccuacgagaucgaggaguucaagaagaccaaggaggccauccgccgcuuccuccucgccuacaagaugaugcucgaguucuucggcaucaagcucaccgacaagaccggcaacgucgcccgcgccgucaacuggcaggagcgcuuccagcaccucaacgagucccagcacaacuaccuccgcaucacccgcauccucaagucccucggcgagcucggcuacgaguccuucaaguccccccucgucaaguucauccuccacgaggcccucgucgagaacaccauccccaacaucaagcaguccgcccucgaguacuucgucuacaccauccgcgaccgccgcgagcgccgcaagcuccuccgcuucgcccagaagcacuacacccccuccgagaacuucaucuggggccccccccgcaaggagcaguccgagggcuccaaggcccagaagauguccuccccccucgccuccucccacaacucccagaccuccaugcacaagaaggccaaggacuccaagaacuccuccuccgccguccaccucaacuccaagaccgccgaggacaagaaggucgcccccaaggagcccgucgaggagaccgaccgccccucccccgagcccuccaacgaggccgccaagccccgcaacaccgagaaggacuccaacgccgagaacaugaacucccagcccgagaagaccgucaccacccccaccgagaagaaggaguccgucucccccgagaacaacgaggagggcggcaacgacaaccaggacaacgagaaccccggcaacaccaacugccacgacgucguccucguccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1169 - RNA, 905 nt, Artificial Sequence
  mRNA product Design3 comprising derived and/or modified sequence from Homo sapiens__NP_008842.1__HsRLN1 (opt2)
gggagagucccgcagucggcguccagcggcucugcuuguucgugugugugucguugcaggccuuauucaagcuuaccaugccccgccucuuccucuuccaccuccucgaguucugccuccuccucaaccaguucucccgcgccgucgccgccaaguggaaggacgacgucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaucaucaugcucgaguucaucgccaaccucccccccgagcucaaggccgcccucuccgagcgccagcccucccuccccgagcuccagcaguacguccccgcccucaaggacuccaaccucuccuucgaggaguucaagaagcucauccgcaaccgccaguccgaggccgccgacuccaaccccuccgagcucaaguaccucggccucgacacccacucccagaagaagcgccgccccuacgucgcccucuucgagaagugcugccucaucggcugcaccaagcgcucccucgccaaguacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1170 - RNA, 905 nt, Artificial Sequence
  mRNA product Design3 comprising derived and/or modified sequence from Homo sapiens__NP_604390.1__HsRLN2 (opt2)
gggagagucccgcagucggcguccagcggcucugcuuguucgugugugugucguugcaggccuuauucaagcuuaccaugccccgccucuucuucuuccaccuccucggcgucugccuccuccucaaccaguucucccgcgccgucgccgacuccuggauggaggaggucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1171 - RNA, 776 nt, Artificial Sequence
  mRNA product Design3 comprising derived and/or modified sequence from Homo sapiens__NP_543140.1__HsRLN3  (opt2)
gggagagucccgcagucggcguccagcggcucugcuuguucgugugugugucguugcaggccuuauucaagcuuaccauggcccgcuacaugcuccuccuccuccucgccgucuggguccucaccggcgagcucuggcccggcgccgaggcccgcgccgcccccuacggcguccgccucugcggccgcgaguucauccgcgccgucaucuucaccugcggcggcucccgcuggcgccgcuccgacauccucgcccacgaggccaugggcgacaccuuccccgacgccgacgccgacgaggacucccucgccggcgagcucgacgaggccaugggcuccuccgaguggcucgcccucaccaaguccccccaggccuucuaccgcggccgccccuccuggcagggcacccccggcguccuccgcggcucccgcgacguccucgccggccucuccuccuccugcugcaaguggggcugcuccaaguccgagaucuccucccucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1172 - RNA, 1757 nt, Artificial Sequence
  mRNA product Design3 comprising derived and/or modified sequence from Homo sapiens__NP_002412.1__HsMMP1 (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1173 - RNA, 1517 nt, Artificial Sequence
  mRNA product Design3 comprising derived and/or modified sequence from Homo sapiens__NP_002412.1__HsMMP1(1-19,100-469) (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1174 - RNA, 3704 nt, Artificial Sequence
  mRNA product Design3 comprising derived and/or modified sequence from Clostridium histolyticum__BAA77453.1__ColG (opt2)
gggagagucccgcagucggcguccagcggcucugcuuguucgugugugugucguugcaggccuuauucaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1175 - RNA, 3428 nt, Artificial Sequence
  mRNA product Design3 comprising derived and/or modified sequence from Clostridium histolyticum__BAA77453.1__HsALB(1-18)_ColG(111-1118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1176 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1177 - RNA, 3452 nt, Artificial Sequence
  mRNA product Design3 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1178 - RNA, 3413 nt, Artificial Sequence
  mRNA product Design3 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1179 - RNA, 3347 nt, Artificial Sequence
  mRNA product Design3 comprising derived and/or modified sequence from Clostridium histolyticum__BAA34542.1__HsALB(1-18)_ColH(41-1021) (opt2)
gggagagucccgcagucggcguccagcggcucugcuuguucgugugugugucguugcaggccuuauucaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1180 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1181 - RNA, 1193 nt, Artificial Sequence
  mRNA product Design3 comprising derived and/or modified sequence from Homo sapiens__NP_003801.1__HsTNFSF10 (opt3)
gggagagucccgcagucggcguccagcggcucugcuuguucgugugugugucguugcaggccuuauucaagcuuaccauggccaugauggaggugcagggcgggcccagccugggacaaaccugcguccucaucguuauuuucacagugcuucugcaguccuuguguguagcugugacuuacgucuauuuuacgaacgaauuaaagcagaugcaggacaaauacucuaagucagguauagcaugcuuccugaaagaggaugacaguuauugggauccuaaugacgaagagagcaugaacuccccauguuggcaagugaaguggcagcuaagacagcucguuaggaaaaugauccugcggaccucugaagagacaauuucgacugugcaggagaagcaacagaauaucucaccgcuuguccgcgaacgaggcccccagcguguggccgcgcacauuaccgggacaagaggaaggagcaacacccugaguuccccuaauucuaagaacgagaaggcuuugggccggaaaaucaauagcugggaauccucacgcaguggucauagcuuucucucuaaccugcaccugagaaauggggagcucguaauacaugagaaaggauucuacuauaucuacucccagacuuauuuuagguuccaagaagagauuaaggaaaacaccaaaaaugauaagcagaugguucaguacaucuacaaguauacaucauacccagaccccauuuuacugaugaaaagcgcccggaacaguugcuggucuaaggaugcagaguauggccuuuacuccaucuaucaaggcgggauauuugaauugaaagagaaugaccgcauuuucgugagcgucacgaacgagcaccugaucgauauggaccaugaagccucguuuuucggagcuuuucuaguggguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1182 - RNA, 914 nt, Artificial Sequence
  mRNA product Design3 comprising derived and/or modified sequence from Homo sapiens__NP_003801.1__HsTNFSF10(95-281) (opt3)
gggagagucccgcagucggcguccagcggcucugcuuguucgugugugugucguugcaggccuuauucaagcuuaccaugaccagcgaagaaacaaucuccacugugcaggagaagcaacagaacauuucuccccuggucagagaaaggggcccucagcggguugccgcucacauaacggggacccgcggacgaucaaauacacucaguagcccaaacuccaaaaaugagaaggcacuuggucguaaaaucaacucuugggaaucgucaagaagcggccauaguuuccuguccaauuugcacuuaaggaacggggagcuggugauucaugagaagggauuuuacuauaucuacucucagacuuauuuccgguuucaagaagagauuaaagaaaauaccaagaacgacaagcagaugguacaguacaucuauaaauacacaagcuauccggaucccauacuacucaugaaguccgcccgcaauucaugcuggaguaaagacgcggaguacggccuguacagcaucuaucagggugggauuuucgagcuuaaggaaaacgauagaaucuuugugucugucaccaaugagcaccugauugacauggaucaugaggcuuccuucuuuggagccuucuuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1183 - RNA, 965 nt, Artificial Sequence
  mRNA product Design3 comprising derived and/or modified sequence from Homo sapiens__NP_003801.1__HsALB(1-18)_HsTNFSF10(95-281) (opt3)
gggagagucccgcagucggcguccagcggcucugcuuguucgugugugugucguugcaggccuuauucaagcuuaccaugaagugggugaccuucaucagccugcucuuucuuuucuccucugccuacucaacaagugaggaaacuauuagcacgguccaggagaaacaacagaacauaucuccccugguuagagaaaggggcccucagcggguggcugcacacaucaccgggacacgcggacgaucuaauacuuugucgucaccaaacagcaagaaugagaaagccuuaggucguaagauuaacaguugggaauccucuagaagcggccauuccuuucugucaaaucuacaccucaggaacggggagcugguaauccaugagaaaggauucuauuacauuuauagucagaccuacuuucgguuccaagaagagaucaaggaaaauacaaagaacgacaaacagauggugcaguauauauacaaguauaccagcuacccggaucccauccuucugaugaaaucugcgcgcaauuccugcuggucaaaggacgcugaguacggcuuguauagcauuuaccagggugggaucuuugagcucaaagaaaacgauagaauuuucgucagugugacuaaugagcaccugaucgacauggaucaugaagccuccuuuuucggagcauuucugguuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1184 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt3)
gggagagucccgcagucggcguccagcggcucugcuuguucgugugugugucguugcaggccuuauucaagcuuaccaugaagugggugaccuucaucagccugcucuuucuuuucuccucugccuacucaagaaugaaacagauugaggacaagauagaagagauccugaguaaaauuuaucacaucgaaaacgagauugcuaggaucaagaaauugauaggcgaaacaagcgaggagacuaucuccacgguccaagaaaagcagcagaauauuucucccuuaguucgggagcgcgggccucagcgaguggcagcccauaucaccggaacacgugguagaucgaacacucugucaagcccaaauaguaagaacgaaaaagcgcuaggcaggaagauuaauuccugggagucuagccgguccgggcacucauuucucaguaaccugcaucuucgcaauggagagcugguaauccacgaaaaaggcuucuacuauauauacagccaaaccuauuuuagauuccaggaggaaauuaaggagaacaccaaaaaugauaagcagauggugcaguacaucuauaaguacacaucuuacccggaccccauuuugcucaugaaauccgcuaggaacucaugcuggagcaaggaugccgaauauggucuguacaguaucuaucaagggggaaucuuugagcugaaagagaaugaccggauuuucgucucugugacuaacgaacaucucauagauauggaccacgaggcauccuuuuucggcgccuuuuuaguuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1185 - RNA, 1424 nt, Artificial Sequence
  mRNA product Design3 comprising derived and/or modified sequence from Rattus norvegicus__NP_036656.1__RnCebpa (opt3)
gggagagucccgcagucggcguccagcggcucugcuuguucgugugugugucguugcaggccuuauucaagcuuaccauggagagcgccgacuucuacgaagcugagcccagaccuccaauguccucucaucugcagucaccgccccacgcaccuaguaacgccgcguuuggcuucccaaggggagcugggcccgccccuccacccgcaccuccagccgcuccggaaccccucgguggcaucugcgagcacgaaaccagcauugauauauccgcauauaucgacccugccgcuuuuaaugaugaguuccuugccgaccuguuucaacauucucggcagcaggagaaggcgaaagcagccgcugggccagccggaggcgguggggauuucgacuaccccggagcuccugcaggcccaggcggggccgugaugucggcgggagcccacggucccccgccuggcuaugggugugcagcugccggauacuuggauggccgcuuagaaccccuguaugagcgagucggugcuccagcccuacguccucucguuauuaagcaggaacccagagaggaggacgaagcaaaacaacuggcccuugcugggcuguuuccauaccagcccccuccaccgcccccuccaccccauccucacgcgucaccagcacacuuggccgcuccccaucuccaguuccagaucgcccacugcggacaaacaacuaugcaucugcagccgggccacccuacgccacccccuacccccgugccaagcccucaccccgcaccagccaugggcgcugccgggcugccgggaccugguggcagucucaagggguuagcaggaccccauccagaucugaggacaggcggugggggcggaggcggggcgggagcugguaaagccaagaaguccguagacaaaaacucuaaugaguaucgggugcgcagagaaaggaacaauauugcaguccgcaagagccgggauaaagccaagcagcgaaacguggagacucagcaaaaaguucuugaauugaccuccgacaaugauagacugaggaagcggguggagcagcuaucacgugagcucgacacacugcgcggcaucuuuagacagcuucccgaaaguagccuggucaaggcuauggggaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1186 - RNA, 1382 nt, Artificial Sequence
  mRNA product Design3 comprising derived and/or modified sequence from Rattus norvegicus__NP_036656.1__RnCebpa(15-344) (opt3)
gggagagucccgcagucggcguccagcggcucugcuuguucgugugugugucguugcaggccuuauucaagcuuaccaugagcucccaucugcagucucccccucacgccccaucaaacgcugcauucggcuuuccgagaggggccggacccgcgccuccacccgcuccuccagccgcacccgagccucucgguggcaucugcgaacacgagaccaguauugacauaagcgccuacaucgauccagcugcauucaaugacgaauuucuugccgaucuguuccaacauuccaggcagcaggagaaggcuaaagccgcggcagggccggccggaggcgguggggacuuugauuaucccggagcuccugccggcccaggcggggcagugaugucugcuggagcccacggucccccuccaggcuacgggugugcggccgcaggauauuuggacggccgguuagaaccccuguacgagcgcgucggugcuccggcccuacgaccucucguuauuaagcaggagccccgugaagaggaugaagcuaaacaacuggcccuugcagggcuguucccauaucagccucccccacccccuccaccgccccauccucacgccucgccagcucacuuggcggcaccccaucuccaguuucagaucgcccacugcggacaaacaacuaugcaucugcagccuggccacccaacgcccccgccuaccccagugcccucaccucaccccgcuccagccaugggcgcagccgggcugccuggacccgguggcagccucaagggguuagcuggaccacauccggaccugagaacaggcggugggggcggaggcggggccggagcagguaaagcgaagaagaguguagauaaaaacuccaaugaguacagggugcggcgcgagagaaacaauauugcugucaggaagucucgggacaaagccaagcagcgcaacguggaaacucagcaaaaaguucuugaguugaccagcgauaaugaccgacugagaaagaggguggaacagcuaucccgggagcucgauacacugcguggcaucuuccgccagcuuccugaaucaagucuggucaaggcaauggggaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1187 - RNA, 1427 nt, Artificial Sequence
  mRNA product Design3 comprising derived and/or modified sequence from Mus musculus__NP_031704.2 __MmCebpa (opt3) R5413
gggagagucccgcagucggcguccagcggcucugcuuguucgugugugugucguugcaggccuuauucaagcuuaccauggaaagcgccgacuucuacgagguggaacccagaccuccuaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1188 - RNA, 1385 nt, Artificial Sequence
  mRNA product Design3 comprising derived and/or modified sequence from Mus musculus__NP_031704.2 __MmCebpa(15-359) (opt3) R5414
gggagagucccgcagucggcguccagcggcucugcuuguucgugugugugucguugcaggccuuauucaagcuuaccaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1189 - RNA, 1424 nt, Artificial Sequence
  mRNA product Design3 comprising derived and/or modified sequence from Homo sapiens__NP_004355.2__HsCEBPA (opt3)
gggagagucccgcagucggcguccagcggcucugcuuguucgugugugugucguugcaggccuuauucaagcuuaccauggagagcgccgacuucuacgaagcugagcccagaccuccaauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1190 - RNA, 1382 nt, Artificial Sequence
  mRNA product Design3 comprising derived and/or modified sequence from Homo sapiens__NP_004355.2__HsCEBPA(15-358) (opt3)
gggagagucccgcagucggcguccagcggcucugcuuguucgugugugugucguugcaggccuuauucaagcuuaccauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1191 - RNA, 1772 nt, Artificial Sequence
  mRNA product Design3 comprising derived and/or modified sequence from Homo sapiens__NP_000448.3__HsHNF4A (opt3)
gggagagucccgcagucggcguccagcggcucugcuuguucgugugugugucguugcaggccuuauucaagcuuaccaugagacugagcaagacccucguggacauggauauggccgacuacuccgcugcacuugaucccgccuauacaacucuggaguucgaaaacguccagguuuugacgaugggcaaugacaccucuccuucagaggggacaaacuuaaaugcgccaaacagucugggagugagcgcucuaugcgccaucuguggugauagggcaacuggcaaacacuacggggccuccucuugcgacggauguaagggcuuuuuccggcgcucgguacguaaaaaucauauguauucaugccgauuuagcagacaauguguggucgauaaggacaaaaggaaccagugccgguacugucgccucaagaagugcuucagagcugguaugaaaaaggaagcagugcagaaugagagggaucggauuaguacccgccgauccucuuaugaagacagcucccugccgucaauaaacgcccuucugcaggcugagguuuugaguagacaaaucacaagccccgugucugggauuaauggagauaucagggccaaaaagauugcguccaucgcagacgucugugagucaaugaaagaacagcuccuggugcugguagagugggccaaguacauaccugcuuuuugcgaacucccauuagaugaccagguugcccugcuucgggcacacgcuggcgagcauuugcugcuaggcgccaccaagcguagcaugguguucaaagacguccuccugcuugggaacgauuauaucgugccccgccacuguccugagcuggcggaaaugaguagagugucuauuaggaucuuggacgagcucguccugccauuucaggaauuacaaauugaugacaaugaguacgccuaccugaaggcaaucauauucuuugaucccgacgcuaaaggacucuccgauccugguaagauuaaacggcuucgaagccagguucaggugucgcuggaagacuauaucaacgaucgccaguacgacucuagaggcagguucggggaguugcuacugcuccugccaacucuucaauccauuacauggcagaugaucgagcagauccaauuuauuaagcuguucggaauggccaaaauagauaauuugcuccaggaaaugcuguuaggcgguucaccgagugacgcuccccaugcccaccacccucugcauccacaccuaaugcaggagcauauggggaccaacguaaucguggcaaauacgaugcccacucaccucagcaacggacagaugugcgaauggccucggccacgcggccaagccgcuacccccgagacaccgcagccuucucccccaggcggguccggaagcgaaccuuauaagcugcuucccggugcggucgcaacuauugugaagccauugucagccaucccccagccuaccauaacaaaacaggagguuauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1192 - RNA, 977 nt, Artificial Sequence
  mRNA product Design3 comprising derived and/or modified sequence from Homo sapiens__NP_061986.1__HsFGF21 (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1193 - RNA, 1703 nt, Artificial Sequence
  mRNA product Design3 comprising derived and/or modified sequence from Homo sapiens__NP_078852.3__HsOGFRL1 (opt3)
gggagagucccgcagucggcguccagcggcucugcuuguucgugugugugucguugcaggccuuauucaagcuuaccaugggcaaccugcucgggggagugagcuucagagagcccaccacagucgaagacugcgauuccacuuggcagacggacucugagccugaaccagaggaaccgggucccggcgggggaucagagggcccuggucaagagagugaacagccagcccagcccccugagcaggcugggggaaggccaggcgcaagccccgccccugaugaagacgcggaggcugccggcgcagagcaagggggagauuccaccgaagccacagcuaagccaaaacggucuuuuuacgcagcccgcgaccuuuauaaguaccgacaccaguauccgaauuucaaagauauccguuaccagaacgaccugucgaauuugagauuuuauaagaacaaaauucccuucaagccugaugguguuuacauagaggaaguguuaucaaaguggaaaggcgacuaugagaagcuggaacauaaucacacuuacauccaguggcuauuuccacucagggagcaagggcugaacuucuacgcuaaagagcuuaccacauaugaaauugaggaauuuaagaaaaccaaggaggccauccggcgcuuccuguuggcguacaagaugaugcucgaauuuuucggaauuaaacugacugauaagacaggcaauguagcaagagccgugaacuggcaggagagguuucagcaucugaaugagagccagcacaacuaucuccggaucacccgcauauuaaaaagucugggugaacuuggguacgaguccuucaagucucccuuggucaaauuuauccugcaugaagcucuaguggagaauacgauuccuaacaucaagcaaagcgcccucgaauauuucguuuacacuauucgagacagaagggagcggcguaaacugcuucgcuucgcacagaagcacuauaccccauccgagaauuuuaucuggggacccccgagaaaggaacagucagagggcaguaaagcucaaaagaugagcucuccucuggccuccucacacaacagccagacaaguaugcauaaaaaggcgaaagauucuaaaaauuccagcucggccgugcacuugaacucuaagacugcagaagacaagaaggucgcucccaaagagccaguggaggaaaccgacaggccuucccccgagccaucaaacgaagccgcuaagccccggaauacagagaaagauaguaacgccgaaaauaugaacagccagccugagaagaccguaacgacuccaacagagaagaaagaauccguuucuccggagaauaacgaagagggcgggaaugacaaccaggauaaugaaaaccccggaaauaccaacugucaugacgugguccucgugcaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1194 - RNA, 905 nt, Artificial Sequence
  mRNA product Design3 comprising derived and/or modified sequence from Homo sapiens__NP_008842.1__HsRLN1 (opt3)
gggagagucccgcagucggcguccagcggcucugcuuguucgugugugugucguugcaggccuuauucaagcuuaccaugcccagacuguuccucuuucaccuucuggaguucugcuuguuacugaaccaguuuagcagggccguggcugcaaaguggaaagacgaugucaucaagcuauguggccgggaacucguucgcgcccaaauugcgauaugcgggauguccaccuggucuaaacgaucacugagucaggaggacgcuccucagacaccacguccgguggccgaaaucguacccagcuucauuaauaaggauacugagacgaucauuaucaugcuugaauuuauagcaaaccugccuccagaguugaaagccgcucucuccgagagacagcccucucugccugaacugcaacaguacgugccagcacucaaggacucgaauuuaucauucgaggaauuuaagaaacugaucaggaaccggcagagcgaggccgcugauaguaaucccuccgagcuuaaguauuugggacuggacacccauucucagaaaaagcgcagaccuuacgucgcccuauucgaaaaauguugccucauugguuguacaaagaggagccuggcgaaguauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1195 - RNA, 905 nt, Artificial Sequence
  mRNA product Design3 comprising derived and/or modified sequence from Homo sapiens__NP_604390.1__HsRLN2 (opt3)
gggagagucccgcagucggcguccagcggcucugcuuguucgugugugugucguugcaggccuuauucaagcuuaccaugcccagacuguucuuuuuccaccuccuuggcgugugccuguuguuaaaccaguuuagcagggccgucgcugacuccuggauggaggaaguuaucaagcugugugggcgggagcuagugcgcgcacaaauugccauaugcggaaugucuaccuggucaaaacgaagucucagccaggaagaugcgccucagacaccacguccgguagcugagaucgugcccuccuucauuaauaaggacacugaaacgaucaacaugaugucugaguuugucgccaaucugccucaggagcuuaaacugaccuugucggaaaugcaaccagcacucccccagcugcagcagcaugugccuguucugaaggauucaagccucuuauucgaggaauuuaaaaagcugauuagaaacaggcaaagugaggccgcugacuccucuccaagcgagcuuaaguacuugggucuggauacacacucccggaaaaagcgccagcuauauucagcacucgccaauaaauguugccaugugggcuguacuaagagaagucuggcuagguucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1196 - RNA, 776 nt, Artificial Sequence
  mRNA product Design3 comprising derived and/or modified sequence from Homo sapiens__NP_543140.1__HsRLN3  (opt3)
gggagagucccgcagucggcguccagcggcucugcuuguucgugugugugucguugcaggccuuauucaagcuuaccauggccagauacaugcugcuccuucuguuggcugugugggucuuaaccggcgagcuguggcccggggcagaagccagggcggcuccuuauggaguucggcuaugcggucgcgaguucauccgagccgugauuuuuacauguggcgggagccguuggagaagguccgacauacucgcacacgaagccaugggagauacuuucccagacgcugaugcagacgaggauucucuggccggcgaacuugacgaggcuauggguucaagugaguggcuggccuugaccaagagcccgcaggcguuuuaccgggggcgccccuccuggcaaggaacgccuggcguacucagaggcucuagggaugugcuggcagggcugucgucaagcugcuguaaauggggaugcaguaaguccgaaaucucuagccucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1197 - RNA, 1757 nt, Artificial Sequence
  mRNA product Design3 comprising derived and/or modified sequence from Homo sapiens__NP_002412.1__HsMMP1 (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1198 - RNA, 1517 nt, Artificial Sequence
  mRNA product Design3 comprising derived and/or modified sequence from Homo sapiens__NP_002412.1__HsMMP1(1-19,100-469) (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1199 - RNA, 3704 nt, Artificial Sequence
  mRNA product Design3 comprising derived and/or modified sequence from Clostridium histolyticum__BAA77453.1__ColG (opt3)
gggagagucccgcagucggcguccagcggcucugcuuguucgugugugugucguugcaggccuuauucaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1200 - RNA, 3428 nt, Artificial Sequence
  mRNA product Design3 comprising derived and/or modified sequence from Clostridium histolyticum__BAA77453.1__HsALB(1-18)_ColG(111-1118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1201 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1202 - RNA, 3452 nt, Artificial Sequence
  mRNA product Design3 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1203 - RNA, 3413 nt, Artificial Sequence
  mRNA product Design3 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1204 - RNA, 3347 nt, Artificial Sequence
  mRNA product Design3 comprising derived and/or modified sequence from Clostridium histolyticum__BAA34542.1__HsALB(1-18)_ColH(41-1021) (opt3)
gggagagucccgcagucggcguccagcggcucugcuuguucgugugugugucguugcaggccuuauucaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1205 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1206 - RNA, 1193 nt, Artificial Sequence
  mRNA product Design3 comprising derived and/or modified sequence from Homo sapiens__NP_003801.1__HsTNFSF10 (opt4)
gggagagucccgcagucggcguccagcggcucugcuuguucgugugugugucguugcaggccuuauucaagcuuaccauggccaugauggaggugcagggcggccccagccugggccagaccugcgugcugaucgugaucuucaccgugcugcugcagagccugugcguggccgugaccuacguguacuucaccaacgagcugaagcagaugcaggacaaguacagcaagagcggcaucgccugcuuccugaaggaggacgacagcuacugggaccccaacgacgaggagagcaugaacagccccugcuggcaggugaaguggcagcugagacagcuggugagaaagaugauccugagaaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1207 - RNA, 914 nt, Artificial Sequence
  mRNA product Design3 comprising derived and/or modified sequence from Homo sapiens__NP_003801.1__HsTNFSF10(95-281) (opt4)
gggagagucccgcagucggcguccagcggcucugcuuguucgugugugugucguugcaggccuuauucaagcuuaccaugaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1208 - RNA, 965 nt, Artificial Sequence
  mRNA product Design3 comprising derived and/or modified sequence from Homo sapiens__NP_003801.1__HsALB(1-18)_HsTNFSF10(95-281) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1209 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt4)
gggagagucccgcagucggcguccagcggcucugcuuguucgugugugugucguugcaggccuuauucaagcuuaccaugaagugggugaccuucaucagccugcuguuccuguucagcagcgccuacagcagaaugaagcagaucgaggacaagaucgaggagauccugagcaagaucuaccacaucgagaacgagaucgccagaaucaagaagcugaucggcgagaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1210 - RNA, 1424 nt, Artificial Sequence
  mRNA product Design3 comprising derived and/or modified sequence from Rattus norvegicus__NP_036656.1__RnCebpa (opt4)
gggagagucccgcagucggcguccagcggcucugcuuguucgugugugugucguugcaggccuuauucaagcuuaccauggagagcgccgacuucuacgaggccgagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1211 - RNA, 1382 nt, Artificial Sequence
  mRNA product Design3 comprising derived and/or modified sequence from Rattus norvegicus__NP_036656.1__RnCebpa(15-344) (opt4)
gggagagucccgcagucggcguccagcggcucugcuuguucgugugugugucguugcaggccuuauucaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1212 - RNA, 1427 nt, Artificial Sequence
  mRNA product Design3 comprising derived and/or modified sequence from Mus musculus__NP_031704.2 __MmCebpa (opt4)
gggagagucccgcagucggcguccagcggcucugcuuguucgugugugugucguugcaggccuuauucaagcuuaccauggagagcgccgacuucuacgagguggagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1213 - RNA, 1385 nt, Artificial Sequence
  mRNA product Design3 comprising derived and/or modified sequence from Mus musculus__NP_031704.2 __MmCebpa(15-359) (opt4)
gggagagucccgcagucggcguccagcggcucugcuuguucgugugugugucguugcaggccuuauucaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1214 - RNA, 1424 nt, Artificial Sequence
  mRNA product Design3 comprising derived and/or modified sequence from Homo sapiens__NP_004355.2__HsCEBPA (opt4)
gggagagucccgcagucggcguccagcggcucugcuuguucgugugugugucguugcaggccuuauucaagcuuaccauggagagcgccgacuucuacgaggccgagcccagaccccccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1215 - RNA, 1382 nt, Artificial Sequence
  mRNA product Design3 comprising derived and/or modified sequence from Homo sapiens__NP_004355.2__HsCEBPA(15-358) (opt4)
gggagagucccgcagucggcguccagcggcucugcuuguucgugugugugucguugcaggccuuauucaagcuuaccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1216 - RNA, 1772 nt, Artificial Sequence
  mRNA product Design3 comprising derived and/or modified sequence from Homo sapiens__NP_000448.3__HsHNF4A (opt4)
gggagagucccgcagucggcguccagcggcucugcuuguucgugugugugucguugcaggccuuauucaagcuuaccaugagacugagcaagacccugguggacauggacauggccgacuacagcgccgcccuggaccccgccuacaccacccuggaguucgagaacgugcaggugcugaccaugggcaacgacaccagccccagcgagggcaccaaccugaacgcccccaacagccugggcgugagcgcccugugcgccaucugcggcgacagagccaccggcaagcacuacggcgccagcagcugcgacggcugcaagggcuucuucagaagaagcgugagaaagaaccacauguacagcugcagauucagcagacagugcgugguggacaaggacaagagaaaccagugcagauacugcagacugaagaagugcuucagagccggcaugaagaaggaggccgugcagaacgagagagacagaaucagcaccagaagaagcagcuacgaggacagcagccugcccagcaucaacgcccugcugcaggccgaggugcugagcagacagaucaccagccccgugagcggcaucaacggcgacaucagagccaagaagaucgccagcaucgccgacgugugcgagagcaugaaggagcagcugcuggugcugguggagugggccaaguacauccccgccuucugcgagcugccccuggacgaccagguggcccugcugagagcccacgccggcgagcaccugcugcugggcgccaccaagagaagcaugguguucaaggacgugcugcugcugggcaacgacuacaucgugcccagacacugccccgagcuggccgagaugagcagagugagcaucagaauccuggacgagcuggugcugcccuuccaggagcugcagaucgacgacaacgaguacgccuaccugaaggccaucaucuucuucgaccccgacgccaagggccugagcgaccccggcaagaucaagagacugagaagccaggugcaggugagccuggaggacuacaucaacgacagacaguacgacagcagaggcagauucggcgagcugcugcugcugcugcccacccugcagagcaucaccuggcagaugaucgagcagauccaguucaucaagcuguucggcauggccaagaucgacaaccugcugcaggagaugcugcugggcggcagccccagcgacgccccccacgcccaccacccccugcacccccaccugaugcaggagcacaugggcaccaacgugaucguggccaacaccaugcccacccaccugagcaacggccagaugugcgaguggcccagacccagaggccaggccgccacccccgagaccccccagcccagcccccccggcggcagcggcagcgagcccuacaagcugcugcccggcgccguggccaccaucgugaagccccugagcgccaucccccagcccaccaucaccaagcaggaggugaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1217 - RNA, 977 nt, Artificial Sequence
  mRNA product Design3 comprising derived and/or modified sequence from Homo sapiens__NP_061986.1__HsFGF21 (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1218 - RNA, 1703 nt, Artificial Sequence
  mRNA product Design3 comprising derived and/or modified sequence from Homo sapiens__NP_078852.3__HsOGFRL1 (opt4)
gggagagucccgcagucggcguccagcggcucugcuuguucgugugugugucguugcaggccuuauucaagcuuaccaugggcaaccugcugggcggcgugagcuucagagagcccaccaccguggaggacugcgacagcaccuggcagaccgacagcgagcccgagcccgaggagcccggccccggcggcggcagcgagggccccggccaggagagcgagcagcccgcccagccccccgagcaggccggcggcagacccggcgccagccccgcccccgacgaggacgccgaggccgccggcgccgagcagggcggcgacagcaccgaggccaccgccaagcccaagagaagcuucuacgccgccagagaccuguacaaguacagacaccaguaccccaacuucaaggacaucagauaccagaacgaccugagcaaccugagauucuacaagaacaagauccccuucaagcccgacggcguguacaucgaggaggugcugagcaaguggaagggcgacuacgagaagcuggagcacaaccacaccuacauccaguggcuguucccccugagagagcagggccugaacuucuacgccaaggagcugaccaccuacgagaucgaggaguucaagaagaccaaggaggccaucagaagauuccugcuggccuacaagaugaugcuggaguucuucggcaucaagcugaccgacaagaccggcaacguggccagagccgugaacuggcaggagagauuccagcaccugaacgagagccagcacaacuaccugagaaucaccagaauccugaagagccugggcgagcugggcuacgagagcuucaagagcccccuggugaaguucauccugcacgaggcccugguggagaacaccauccccaacaucaagcagagcgcccuggaguacuucguguacaccaucagagacagaagagagagaagaaagcugcugagauucgcccagaagcacuacacccccagcgagaacuucaucuggggcccccccagaaaggagcagagcgagggcagcaaggcccagaagaugagcagcccccuggccagcagccacaacagccagaccagcaugcacaagaaggccaaggacagcaagaacagcagcagcgccgugcaccugaacagcaagaccgccgaggacaagaagguggcccccaaggagcccguggaggagaccgacagacccagccccgagcccagcaacgaggccgccaagcccagaaacaccgagaaggacagcaacgccgagaacaugaacagccagcccgagaagaccgugaccacccccaccgagaagaaggagagcgugagccccgagaacaacgaggagggcggcaacgacaaccaggacaacgagaaccccggcaacaccaacugccacgacguggugcuggugcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1219 - RNA, 905 nt, Artificial Sequence
  mRNA product Design3 comprising derived and/or modified sequence from Homo sapiens__NP_008842.1__HsRLN1 (opt4)
gggagagucccgcagucggcguccagcggcucugcuuguucgugugugugucguugcaggccuuauucaagcuuaccaugcccagacuguuccuguuccaccugcuggaguucugccugcugcugaaccaguucagcagagccguggccgccaaguggaaggacgacgugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaucaucaugcuggaguucaucgccaaccugccccccgagcugaaggccgcccugagcgagagacagcccagccugcccgagcugcagcaguacgugcccgcccugaaggacagcaaccugagcuucgaggaguucaagaagcugaucagaaacagacagagcgaggccgccgacagcaaccccagcgagcugaaguaccugggccuggacacccacagccagaagaagagaagacccuacguggcccuguucgagaagugcugccugaucggcugcaccaagagaagccuggccaaguacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1220 - RNA, 905 nt, Artificial Sequence
  mRNA product Design3 comprising derived and/or modified sequence from Homo sapiens__NP_604390.1__HsRLN2 (opt4)
gggagagucccgcagucggcguccagcggcucugcuuguucgugugugugucguugcaggccuuauucaagcuuaccaugcccagacuguucuucuuccaccugcugggcgugugccugcugcugaaccaguucagcagagccguggccgacagcuggauggaggaggugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugaucagaaacagacagagcgaggccgccgacagcagccccagcgagcugaaguaccugggccuggacacccacagcagaaagaagagacagcuguacagcgcccuggccaacaagugcugccacgugggcugcaccaagagaagccuggccagauucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1221 - RNA, 776 nt, Artificial Sequence
  mRNA product Design3 comprising derived and/or modified sequence from Homo sapiens__NP_543140.1__HsRLN3  (opt4)
gggagagucccgcagucggcguccagcggcucugcuuguucgugugugugucguugcaggccuuauucaagcuuaccauggccagauacaugcugcugcugcugcuggccgugugggugcugaccggcgagcuguggcccggcgccgaggccagagccgcccccuacggcgugagacugugcggcagagaguucaucagagccgugaucuucaccugcggcggcagcagauggagaagaagcgacauccuggcccacgaggccaugggcgacaccuuccccgacgccgacgccgacgaggacagccuggccggcgagcuggacgaggccaugggcagcagcgaguggcuggcccugaccaagagcccccaggccuucuacagaggcagacccagcuggcagggcacccccggcgugcugagaggcagcagagacgugcuggccggccugagcagcagcugcugcaaguggggcugcagcaagagcgagaucagcagccugugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1222 - RNA, 1757 nt, Artificial Sequence
  mRNA product Design3 comprising derived and/or modified sequence from Homo sapiens__NP_002412.1__HsMMP1 (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1223 - RNA, 1517 nt, Artificial Sequence
  mRNA product Design3 comprising derived and/or modified sequence from Homo sapiens__NP_002412.1__HsMMP1(1-19,100-469) (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1224 - RNA, 3704 nt, Artificial Sequence
  mRNA product Design3 comprising derived and/or modified sequence from Clostridium histolyticum__BAA77453.1__ColG (opt4)
gggagagucccgcagucggcguccagcggcucugcuuguucgugugugugucguugcaggccuuauucaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1225 - RNA, 3428 nt, Artificial Sequence
  mRNA product Design3 comprising derived and/or modified sequence from Clostridium histolyticum__BAA77453.1__HsALB(1-18)_ColG(111-1118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1226 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1227 - RNA, 3452 nt, Artificial Sequence
  mRNA product Design3 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1228 - RNA, 3413 nt, Artificial Sequence
  mRNA product Design3 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1229 - RNA, 3347 nt, Artificial Sequence
  mRNA product Design3 comprising derived and/or modified sequence from Clostridium histolyticum__BAA34542.1__HsALB(1-18)_ColH(41-1021) (opt4)
gggagagucccgcagucggcguccagcggcucugcuuguucgugugugugucguugcaggccuuauucaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1230 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1231 - RNA, 1193 nt, Artificial Sequence
  mRNA product Design3 comprising derived and/or modified sequence from Homo sapiens__NP_003801.1__HsTNFSF10 (opt5)
gggagagucccgcagucggcguccagcggcucugcuuguucgugugugugucguugcaggccuuauucaagcuuaccauggccaugauggaggugcagggcgggcccagccugggacaaaccugcguccucaucguuauuuucacagugcugcuucagucccuguguguggcugucacguacguguauuuuaccaacgaacucaagcagaugcaggacaaauacucuaagagcggcaucgccugcuuccugaaagaggaugacuccuauugggauccuaaugacgaagagucuaugaacagcccguguuggcaaguuaaguggcagcuuagacagcuggugcggaaaaugauucuccgcacauccgaagagaccaucucuacaguccaggagaagcaacagaauauuagcccccuggugagagaacgggggccucagcgcguugcggcucacaucaccggaacaagaggccgguccaacacccugagcucucccaauuccaagaacgagaaagcccucgggcgcaagaucaauagcugggaaucuuccagaagcggacauucuuuucuguccaaccuucaucugcggaauggcgagcucgugauucacgagaaaggcuucuacuauaucuacagccagacguauuuucgcuuccaagaagagauuaaggaaaacaccaaaaaugauaagcagaugguccaguacaucuacaaguauacauccuacccugaccccauucugcuuaugaaaucugccagaaacagcugcugguccaaggaugcugaguaugggcuguacagcaucuaucaaggaggcauuuuugaacucaaagagaaugaccggaucuucgugucugugaccaacgagcaccugaucgauauggaccaugaagccuccuuuuucggggcuuuucuggucggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1232 - RNA, 914 nt, Artificial Sequence
  mRNA product Design3 comprising derived and/or modified sequence from Homo sapiens__NP_003801.1__HsTNFSF10(95-281) (opt5)
gggagagucccgcagucggcguccagcggcucugcuuguucgugugugugucguugcaggccuuauucaagcuuaccaugaccagcgaggaaacaaucuccacggugcaggagaagcaacagaacauuucuccccuggucagagaacggggcccucagcgcguugccgcucacaucaccgggacaagaggacggagcaauacccucuccucuccgaacagcaaaaaugagaaggcccugggccgcaaaauuaacuccugggaaucuagcagauccgggcauagcuuccuuucuaaucugcaccuccggaacggagagcuggugauccaugagaagggcuuuuacuauauuuacucccagacauauuuccgcuuucaagaagagaucaaagaaaauaccaagaacgacaagcagauggugcaguacaucuauaaauacacaagcuaucccgauccuauucuucugaugaagucugcgagaaauuccugcuggagcaaagacgcugaguacgggcucuacucuaucuaucagggaggcauuuucgagcugaaggaaaacgaucggaucuuugucuccgugaccaaugagcaccugauugacauggaucaugaagccagcuucuuuggcgccuuccucguugggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1233 - RNA, 965 nt, Artificial Sequence
  mRNA product Design3 comprising derived and/or modified sequence from Homo sapiens__NP_003801.1__HsALB(1-18)_HsTNFSF10(95-281) (opt5)
gggagagucccgcagucggcguccagcggcucugcuuguucgugugugugucguugcaggccuuauucaagcuuaccaugaagugggugaccuucaucagccugcucuuucuguucuccucugccuacagcacauccgaggaaacgauuucuaccguccaggagaaacaacagaacaucagcccccuuguuagagaacggggcccucagcgcguggcugcccacauuacagggaccagaggacgguccaauacacugucuagcccgaacuccaagaaugagaaagcgcucggccgcaagaucaacagcugggaaucuuccagaagcgggcauucuuuucuguccaaucuucaucugcggaacggagagcucgugauucacgagaaaggcuucuauuacaucuauagccagaccuacuuucgcuuccaagaagagaucaaggaaaauacaaagaacgacaaacagaugguccaguauauuuacaaguauaccucuuaccccgauccuauccugcugaugaaauccgcuagaaauagcugcugguccaaggacgccgaguacgggcucuauucuauuuaccagggaggcaucuuugagcugaaagaaaacgaucggauuuucgugagcguuacgaaugagcaccuuaucgacauggaucaugaagccuccuuuuucggcgcuuuucugguggggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1234 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt5)
gggagagucccgcagucggcguccagcggcucugcuuguucgugugugugucguugcaggccuuauucaagcuuaccaugaagugggugaccuucaucagccugcucuuucuguucuccucugccuacagcagaaugaaacagauugaggacaagaucgaagagauucuuuccaaaaucuaucacauugaaaacgagaucgcucggaucaagaaacugauuggcgaaacaucugaggagacgaucagcaccguccaagaaaagcagcagaauauuucuccccucguucgcgagagagggccucagcggguggccgcgcauaucacaggaacccgcggcagauccaacacacugagcuccccgaauagcaagaacgaaaaagcucuugggcggaagauuaauucuugggaguccagccgcucuggacacuccuuucugagcaaccuccaucugagaaauggcgagcuggugauccacgaaaaaggguucuacuauauuuacucucaaaccuauuuucgguuccaggaggaaaucaaggagaacaccaaaaaugauaagcagaugguccaguacaucuauaaguacacauccuaccccgacccuauucuccugaugaaaagcgcccgcaacuccugcuggucuaaggaugccgaauauggacuuuacagcaucuaucaaggcggcauuuuugagcugaaagagaaugacagaaucuucguguccguuacgaacgaacaucucauugauauggaccacgaggcuagcuuuuucggggccuuucuggugggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1235 - RNA, 1424 nt, Artificial Sequence
  mRNA product Design3 comprising derived and/or modified sequence from Rattus norvegicus__NP_036656.1__RnCebpa (opt5)
gggagagucccgcagucggcguccagcggcucugcuuguucgugugugugucguugcaggccuuauucaagcuuaccauggagagcgccgacuucuacgaagcugagcccagaccuccgauguccucucaucugcagagcccuccccacgcccccuccaacgcggcuuuuggcuucccucgcggggccggacccgccccuccgcccgcuccucccgccgcuccugaaccccucggcgggaucugcgagcacgaaaccucuauugauaucagcgccuauauugacccggcggccuuuaaugaugaguuccuggcugaccuuuuucaacauucccggcagcaggagaaggccaaagcugccgcgggaccugccggcgggggaggcgauuucgacuaccccggcgcuccugccgggcccggaggcgcugugaugucugccggggcccacggacccccuccgggcuaugggugugcugcggccggauaccuggauggcagacucgaaccccuguaugagcgggucggcgcuccugcccuucgcccccugguuaucaagcaggaaccuagagaggaggacgaagccaaacaacucgcucuggccgggcuguuucccuaccagccgccucccccucccccucccccgcauccucacgcgagccccgcucaccucgccgcuccccaucugcaguuccagauugcccacugcggacaaacaacgaugcaucuucagccuggccacccgacacccccucccaccccugugcccuccccucaccccgccccggcuaugggggccgcgggacugccuggccccgggggaagccucaagggccuggccggcccucaucccgaucuucggaccgggggaggcgggggaggcggggcuggcgccggaaaagcuaagaagucuguggacaaaaacuccaaugaguaucgcgucagacgggaacgcaacaauaucgccgugagaaagagccgggauaaagcgaagcagcgcaacguugagacacagcaaaaagugcuggaacucaccucugacaaugauagacugcggaagcgcgucgagcagcuguccagagagcucgacacacugcggggcaucuuuagacagcuuccggaaagcucucuggugaaggccauggggaacugugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1236 - RNA, 1382 nt, Artificial Sequence
  mRNA product Design3 comprising derived and/or modified sequence from Rattus norvegicus__NP_036656.1__RnCebpa(15-344) (opt5)
gggagagucccgcagucggcguccagcggcucugcuuguucgugugugugucguugcaggccuuauucaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacccugcccccgcuaugggggccgcuggacugccuggccccgggggaucccucaagggccuggccggcccgcauccugaccuuagaaccgggggaggcgggggaggcggggcgggcgccggaaaagcuaaaaagagcguggauaagaacucuaaugaguaccggguccgcagagagcggaacaauaucgccgugcgcaaguccagagacaaagcuaagcagcggaacguugaaacacagcaaaaagugcuggagcucaccagcgauaaugaccgccugagaaagcgggucgaacagcugucucgcgagcucgauacacugagaggcaucuuccggcagcuucccgaauccagccuggugaaggccauggggaacugugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1237 - RNA, 1427 nt, Artificial Sequence
  mRNA product Design3 comprising derived and/or modified sequence from Mus musculus__NP_031704.2 __MmCebpa (opt5)
gggagagucccgcagucggcguccagcggcucugcuuguucgugugugugucguugcaggccuuauucaagcuuaccauggagagcgccgacuucuacgaaguggagcccagaccuccgauguccucucaucugcagagcccuccccacgcucccuccaacgccgcguuuggcuucccucgcggggcuggacccgccccuccgcccgccccucccgcugccccugaaccccucggcgggaucugcgagcacgaaaccucuauugauaucagcgcuuauauugacccggccgcguuuaaugaugaguuccuggccgaccuuuuucaacauucccggcagcaggagaaggcuaaagccgcugccggaccugcgggcgggggaggcgauuucgacuaccccggcgccccugcugggcccggaggcgccgucaugucugcuggggcccacggacccccuccgggcuaugggugugccgcugcgggauaccuggauggcagacucgaaccccuguaugagcggguuggcgccccugcccuucgcccccuggugaucaagcaggaaccuagagaggaggacgaagccaaacaacucgcccuggcugggcuguuucccuaccagccgccucccccucccccucccccgcauccucacgccagccccgcgcaccucgcugcuccccaucugcaguuccagauugcccacugcggacaaacaacgaugcaucuucagccuggccacccgacacccccucccaccccugugcccuccccucacgcugcccccgcucugggggccgcgggacucccgggcccugggagcgcccugaagggacuugcuggcgcccaucccgaucugcggaccggcgggggaggcgggggaucuggcgcuggggccggcaaagcgaagaaguccgucgacaaaaacagcaaugaguaucgcgugagacgggaacgcaacaauaucgccguuagaaagucucgggauaaagcuaagcagcgcaacguggagacacagcaaaaaguccucgaacugaccuccgacaaugauagacugcggaagcgcguggagcagcucagcagagagcuggacacacuucggggaaucuuuagacagcugccugaaucuucccucguuaaggccaugggcaacugugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1238 - RNA, 1385 nt, Artificial Sequence
  mRNA product Design3 comprising derived and/or modified sequence from Mus musculus__NP_031704.2 __MmCebpa(15-359) (opt5)
gggagagucccgcagucggcguccagcggcucugcuuguucgugugugugucguugcaggccuuauucaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacgccgcuccugcccugggggcugccggacuccccggcccuggguccgcgcugaagggacuugccggcgcucaucccgaccugagaaccggcgggggaggcgggggaagcggcgccggggcuggcaaagccaagaagucuguggauaaaaacuccaaugaguaccggguccgcagagagcggaacaauaucgcggugcgcaagagcagagacaaagccaagcagcggaacguugaaacacagcaaaaagugcucgagcugaccucugauaaugaccgccugagaaagcgggucgaacagcucucccgcgagcuggauacacuuagaggaaucuuccggcagcugccggaaagcucucucgugaaggcuaugggcaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1239 - RNA, 1424 nt, Artificial Sequence
  mRNA product Design3 comprising derived and/or modified sequence from Homo sapiens__NP_004355.2__HsCEBPA (opt5)
gggagagucccgcagucggcguccagcggcucugcuuguucgugugugugucguugcaggccuuauucaagcuuaccauggagagcgccgacuucuacgaagcugagcccagaccuccgauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1240 - RNA, 1382 nt, Artificial Sequence
  mRNA product Design3 comprising derived and/or modified sequence from Homo sapiens__NP_004355.2__HsCEBPA(15-358) (opt5)
gggagagucccgcagucggcguccagcggcucugcuuguucgugugugugucguugcaggccuuauucaagcuuaccauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1241 - RNA, 1772 nt, Artificial Sequence
  mRNA product Design3 comprising derived and/or modified sequence from Homo sapiens__NP_000448.3__HsHNF4A (opt5)
gggagagucccgcagucggcguccagcggcucugcuuguucgugugugugucguugcaggccuuauucaagcuuaccaugagacugagcaagacccucguggacauggauauggccgacuacuccgcugcccuggaucccgcguauacaacgcuugaguucgaaaacguccagguucugaccaugggcaaugacacaucuccuagcgaggggaccaaccucaaugcuccgaacucccugggagugucugcccuuugcgccaucuguggcgaucgggcuacagggaaacacuacggagccagcuccugcgacggcuguaagggguuuuuccgcagaucugugcggaaaaaucauauguauagcugccgcuuuuccagacaaugugucguggauaaggacaaacggaaccagugccgcuacuguagacugaagaagugcuuccgggcuggaaugaaaaaggaagccguucagaaugagcgcgauagaauuagcacccggcgcagcuccuaugaagacagcucucuccccuccaucaacgcgcugcugcaggccgaggugcucagcagacaaauuacaucuccugucuccggcaucaauggcgauauucgggcuaaaaagaucgccagcaucgcugacgugugugaguccaugaaagaacagcugcuuguucugguggagugggccaaguacauucccgcguuuugcgaacucccucuggaugaccaggucgcccuucugcgcgcucacgccggggagcaucuccugcugggagcuaccaagagaucuaugguguucaaagacgugcuccugcuuggcaacgauuauaucgucccccggcacuguccugagcuggccgaaaugagcagaguuuccauucgcauccucgacgagcuggugcuuccguuucaggaacugcaaauugaugacaaugaguacgccuaccucaaggcuaucauuuucuuugaucccgacgcgaaagggcugagcgauccuggaaagaucaaacggcugagaucucaggugcaggucucccucgaagacuauaucaacgaucgccaguacgacagccggggcagauucggggagcugcuucugcuccugcccacgcuucaaucuauuaccuggcagaugaucgagcagauucaauuuaucaagcuguucggaauggccaaaauugauaaucuccugcaggaaaugcugcucggcggcagcccuuccgacgcuccccaugcccaccacccgcugcauccucaccuuaugcaggagcauauggggacaaacgugaucguugccaauaccaugcccacacaccugucuaacggacagaugugcgaauggccucgcccccggggccaagcugccacccccgagacgccucagccgucucccccugggggauccggcagcgaacccuauaagcuccugccuggggcgguggcuacaaucgucaagccccugucugccauuccgcagccuaccaucacaaaacaggaggugauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1242 - RNA, 977 nt, Artificial Sequence
  mRNA product Design3 comprising derived and/or modified sequence from Homo sapiens__NP_061986.1__HsFGF21 (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1243 - RNA, 1703 nt, Artificial Sequence
  mRNA product Design3 comprising derived and/or modified sequence from Homo sapiens__NP_078852.3__HsOGFRL1 (opt5)
gggagagucccgcagucggcguccagcggcucugcuuguucgugugugugucguugcaggccuuauucaagcuuaccaugggcaaccugcucgggggagugagcuucagagagcccaccacagucgaagacugcgauuccacguggcagaccgacucugagccugaaccggaggaacccggcccugggggaggcagcgaggggcccggacaagaguccgaacagccugcccagcccccugagcaggcuggcggccggccgggggccucucccgcgccugaugaagacgcugaggccgccggagcugagcaaggcggggauagcacagaagccaccgcuaagcccaaacgcuccuuuuacgccgcgagagaccuguauaaguaccggcaccaguauccuaauuucaaagauauccgcuaccagaacgaccuuucuaaucugagauuuuauaagaacaaaauucccuucaagccggauggaguuuacaucgaggaagugcucagcaaguggaaaggcgacuaugagaagcuggaacauaaucacacauacauucaguggcuuuuuccucugcgggagcaagggcucaacuucuacgccaaagagcugaccacauaugaaaucgaggaauuuaagaaaaccaaggaggcuauucgcagauuccugcucgccuacaagaugaugcuggaauuuuucggaaucaaacuuacggauaagaccggcaauguggcucgggccgucaacuggcaggagcgcuuucagcaucugaaugagucccagcacaacuaucucagaaucacacggauucugaaaagccuuggcgaacugggguacgagucuuucaagucuccccucgugaaauuuauccugcaugaagcgcugguugagaauaccauuccuaacaucaagcaaagcgcccucgaauauuucguguacacaauucgcgacagacgggagcgcagaaaacugcuucgguucgcucagaagcacuauacccccucugagaauuuuaucuggggacccccuagaaaggaacaguccgagggcagcaaagcccaaaagaugucuuccccgcuggcuagcucccacaacucucagacgagcaugcauaaaaaggccaaagauuccaagaauagcuccuccgccguccaccucaacagcaagacagcugaagacaaaaagguggcgcccaaagagccuguugaggaaaccgaccgccccucuccugagcccagcaacgaagccgcuaagccgcggaauacagagaaagauuccaacgccgaaaauaugaacucucagccugagaagaccgugaccacacccacggagaagaaagaaagcgucuccccugagaauaacgaagaagggggaaaugacaaccaggauaaugagaaccccggcaauaccaacugucaugacguggugcugguccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1244 - RNA, 905 nt, Artificial Sequence
  mRNA product Design3 comprising derived and/or modified sequence from Homo sapiens__NP_008842.1__HsRLN1 (opt5)
gggagagucccgcagucggcguccagcggcucugcuuguucgugugugugucguugcaggccuuauucaagcuuaccaugcccagacuguuccucuuucaccuucuugaguucugccugcuccugaaccaguuuagccgggccguggcugccaaguggaaagacgaugucaucaagcuguguggccgcgaacugguuagagcgcaaauugcuaucugcgggauguccaccuggucuaaacggagccucucccaggaggacgccccucagacaccgcgccccguggccgaaauugugccuucuuucaucaauaaggauacggagaccauuaucaucaugcuggaauuuauugcuaaccugcccccugagcucaaagccgcucugagcgagagacagcccucccuuccugaacugcaacaguacgucccggcccucaaggacucuaaucugagcuucgaggaauuuaagaaacuuauccggaaccgccaguccgaggcggccgauagcaaucccucugagcugaaguaucucggacuggacacacauucccagaaaaagagacggccuuacguggcucuguucgaaaaauguugccucauuggcuguaccaagcgcagccuggccaaguauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1245 - RNA, 905 nt, Artificial Sequence
  mRNA product Design3 comprising derived and/or modified sequence from Homo sapiens__NP_604390.1__HsRLN2 (opt5)
gggagagucccgcagucggcguccagcggcucugcuuguucgugugugugucguugcaggccuuauucaagcuuaccaugcccagacuguucuuuuuccaccuccugggcgugugccuucugcucaaccaguuuagccgggccgucgcugacuccuggauggaggaaguuaucaagcugugugggcgcgagcuugugagagcccaaauugcgaucugcggaaugucuaccuggagcaaacggucccugucucaggaagaugcuccucagacaccgcgccccguggccgagauugucccuagcuucaucaauaaggacacggaaaccauuaacaugauguccgaguuuguggccaaucucccccaggagcugaaacugacacucucugaaaugcaaccugcucugccccagcuucagcagcauguuccugugcugaaggauagcucccuccuguucgaggaauuuaaaaagcugaucagaaaccggcaaagcgaggccgcugacucuuccccgagcgagcuuaaguaccucggccuggauacccacucucgcaaaaagagacagcuguauuccgcccucgcgaauaaauguugccaugucggguguacaaagcggagccuggcccgcuucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1246 - RNA, 776 nt, Artificial Sequence
  mRNA product Design3 comprising derived and/or modified sequence from Homo sapiens__NP_543140.1__HsRLN3  (opt5)
gggagagucccgcagucggcguccagcggcucugcuuguucgugugugugucguugcaggccuuauucaagcuuaccauggccagauacaugcugcuccugcuucuggcuguguggguccucaccggcgagcuguggcccggggccgaagcgcgggcugccccuuauggaguucgccuuugcggcagagaguucauccgggccgugauuuuuacaugugggggaagccgcuggagacgguccgacauccuggcucacgaagccaugggcgauacguucccggacgcugaugccgacgaggauucucucgcgggggaacuggacgaggccaugggaagcuccgaguggcuggcucucaccaagucuccccaggccuuuuaccgcggcagaccuagcuggcaaggcacacccggggugcugcggggaucccgcgauguccuugcuggccugucuagcuccugcuguaaaugggggugcagcaagucugaaauuuccagccucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1247 - RNA, 1757 nt, Artificial Sequence
  mRNA product Design3 comprising derived and/or modified sequence from Homo sapiens__NP_002412.1__HsMMP1 (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1248 - RNA, 1517 nt, Artificial Sequence
  mRNA product Design3 comprising derived and/or modified sequence from Homo sapiens__NP_002412.1__HsMMP1(1-19,100-469) (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1249 - RNA, 3704 nt, Artificial Sequence
  mRNA product Design3 comprising derived and/or modified sequence from Clostridium histolyticum__BAA77453.1__ColG (opt5)
gggagagucccgcagucggcguccagcggcucugcuuguucgugugugugucguugcaggccuuauucaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1250 - RNA, 3428 nt, Artificial Sequence
  mRNA product Design3 comprising derived and/or modified sequence from Clostridium histolyticum__BAA77453.1__HsALB(1-18)_ColG(111-1118) (opt5)
gggagagucccgcagucggcguccagcggcucugcuuguucgugugugugucguugcaggccuuauucaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1251 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1252 - RNA, 3452 nt, Artificial Sequence
  mRNA product Design3 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1253 - RNA, 3413 nt, Artificial Sequence
  mRNA product Design3 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1254 - RNA, 3347 nt, Artificial Sequence
  mRNA product Design3 comprising derived and/or modified sequence from Clostridium histolyticum__BAA34542.1__HsALB(1-18)_ColH(41-1021) (opt5)
gggagagucccgcagucggcguccagcggcucugcuuguucgugugugugucguugcaggccuuauucaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1255 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1256 - RNA, 1193 nt, Artificial Sequence
  mRNA product Design3 comprising derived and/or modified sequence from Homo sapiens__NP_003801.1__HsTNFSF10 (opt6)
gggagagucccgcagucggcguccagcggcucugcuuguucgugugugugucguugcaggccuuauucaagcuuaccauggcaaugauggaaguacaaggaggaccaucacuaggacaaacaugcguacuaauaguaauauucacaguacuacuccaaucacuaugugucgcagucacauacguauacuucacaaacgaauuaaaacaaaugcaagauaaauacucaaaaucaggaauagcuugcuucuuaaaagaagacgacucauacugggaccccaacgacgaagaaucaaugaauagcccaugcuggcaaguaaaauggcaacuaagacaauuaguaagaaaaaugauacuaagaacaucagaagaaacaauaucaacaguacaagaaaaacaacaaaacauaucaccccuaguaagagaaagaggaccacaaagaguagcagcacacauaacaggaacaagaggaagaagcaacacacuaucaaguccaaacagcaaaaacgaaaaagcacucggaagaaaaauaaacucaugggaauccagcagaagcggacacucauucuuaucaaaccuacauuuacgaaauggagaauuaguaauacacgaaaaaggauucuacuacauauacucacaaaccuacuucagauuccaagaagaaauaaaagaaaacaccaaaaacgacaaacaaaugguacaauacauauacaaauacacaucauauccagacccaauacuauuaaugaaaucagcaagaaauagcugcuggucaaaagacgcagaauacggacuauacucaauauaccaaggcggaauauucgaauuaaaagaaaacgacagaauauucguaucaguaacaaacgaacaccuaauagacauggaccacgaagcaaguuucuucggugcauucuuaguaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1257 - RNA, 914 nt, Artificial Sequence
  mRNA product Design3 comprising derived and/or modified sequence from Homo sapiens__NP_003801.1__HsTNFSF10(95-281) (opt6)
gggagagucccgcagucggcguccagcggcucugcuuguucgugugugugucguugcaggccuuauucaagcuuaccaugacaagcgaagaaacaauaagcacaguacaagaaaaacaacaaaacauaagcccccuaguaagagaaagaggaccacaacgaguagcagcacacauaacaggaacaagaggaagaucaaacacacuaagcucaccaaacaguaaaaacgaaaaagcauuaggaagaaaaauaaacucaugggaaucaagcagaagcggacacucauucuuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaaguuacccagacccaauacuacuaaugaaaucagcaagaaacagcugcuggucaaaagacgccgaauacggacuauacucaauauaccaaggaggaauauucgaacuaaaagaaaacgacagaauauucgucucaguaacaaacgaacacuuaauagacauggaccacgaagcaucauucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1258 - RNA, 965 nt, Artificial Sequence
  mRNA product Design3 comprising derived and/or modified sequence from Homo sapiens__NP_003801.1__HsALB(1-18)_HsTNFSF10(95-281) (opt6)
gggagagucccgcagucggcguccagcggcucugcuuguucgugugugugucguugcaggccuuauucaagcuuaccaugaaauggguaacauucauauccuuacuauuccuauucucaucagcauacucaacaucagaagaaacaauaucaacaguacaagaaaaacaacaaaacauauccccacuuguaagagaacgaggaccacaaagaguagcagcacacauaacaggaacaagaggaagauccaacacacuaucauccccaaacucaaaaaacgaaaaagcacuaggaagaaaaauaaacucaugggaaucauccagaucaggacacagcuuccuaucaaacuuacacuuaagaaacggagaacuuguaauacacgaaaaaggauucuacuacauauacucacaaacauacuucagauuccaagaagaaauaaaagaaaacacaaaaaacgacaaacaaaugguacaauacauauacaaauauacaucauacccagacccaauacuacuaaugaaaucagcaagaaacucaugcuggucaaaagacgcagaauacggacuauacagcauauaccaaggaggaauauucgaacuaaaagaaaacgacagaauauucguaucaguaacaaacgaacacuuaauagacauggaccacgaagcauccuucuucggagccuuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1259 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt6)
gggagagucccgcagucggcguccagcggcucugcuuguucgugugugugucguugcaggccuuauucaagcuuaccaugaaauggguaacauucauaucacucuuauucuuauucucaagcgcauacucaagaaugaaacaaauagaagacaaaauagaagaaauauuaucaaaaauauaccauaucgaaaacgaaauagcaagaauaaaaaaauuaauaggagaaacaucagaagaaacaauaagcacgguacaagaaaaacaacaaaacauaagcccacuuguaagagaaagaggaccacaaagaguagcagcacacauaaccggaacaagaggcagaagcaauacacuaucaucaccaaauagcaaaaacgaaaaagcacuaggaagaaaaauaaacaguugggaaucaagcagaagcggacacucauuccuaagcaaccuacaccuaaggaacggagaauuaguaauacacgaaaaaggauuuuacuacauauacucacaaacauacuucagauuccaagaagaaauaaaagaaaacacaaaaaacgacaaacaaaugguacaauacauauacaaauacacaagcuauccagacccaauacuacuaaugaaaagugcaagaaauagcugcuggucaaaagacgccgaauacggacuauacagcauauaccaaggaggaauauucgaauuaaaagaaaacgaccgaauauuuguaaguguaacaaacgaacaccuaauagacauggaccacgaagcuagcuucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1260 - RNA, 1424 nt, Artificial Sequence
  mRNA product Design3 comprising derived and/or modified sequence from Rattus norvegicus__NP_036656.1__RnCebpa (opt6)
gggagagucccgcagucggcguccagcggcucugcuuguucgugugugugucguugcaggccuuauucaagcuuaccauggaaucagcugacuuuuaugaagcagaaccaagaccaccaaugucuucacaucuacaaaguccuccacaugcaccaucuaaugcagcuuuuggauuuccaagaggagcaggaccugcaccaccaccagcaccuccagcagcucccgaaccccuaggagguauaugugaacaugaaacaaguauagauauaagugcauacauagauccagcagcauuuaacgacgaauuuuuagcugaccuauuucaacauuccagacaacaagaaaaagcaaaagcugcagccggaccagcaggaggaggaggugauuucgacuauccaggagcaccagcaggaccuggcggagcaguaaugucagcaggagcacauggaccaccaccuggauacggaugugcagcagcuggauauuuagacggaagauuagaaccauuauaugaaagaguaggagcaccagcauuacguccauuaguaauaaaacaagaaccaagagaagaagacgaagcaaaacaacuagcacuugcagguuuauuuccauaucaaccaccuccuccaccaccaccaccacacccacacgccucaccagcacauuuagcagcaccucaucuacaauuucaaauagcacauuguggacaaacgacuaugcaucuacaaccaggacauccaacaccaccaccaacaccaguuccaucaccucauccagcacccgcuaugggagcagcaggccuaccaggaccaggagguucgcuaaaaggacucgcaggaccccauccagauuuaagaacaggagguggaggaggaggaggagcaggagcuggaaaagcaaaaaaaucaguagauaaaaacucaaacgaauacagagucagaagagaaagaaauaauauagcuguaagaaaaucaagagacaaagcaaaacaaagaaauguagaaacacaacaaaaaguacuugaauuaacaucugacaaugauagauuaagaaaaagaguagaacaauuaucaagagaacuagacacacuaagaggaauauuuagacaacuaccagaaucaagcuuaguuaaagccauggguaauugugcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1261 - RNA, 1382 nt, Artificial Sequence
  mRNA product Design3 comprising derived and/or modified sequence from Rattus norvegicus__NP_036656.1__RnCebpa(15-344) (opt6)
gggagagucccgcagucggcguccagcggcucugcuuguucgugugugugucguugcaggccuuauucaagcuuaccaugaguucacauuuacaaagccccccucaugcaccaucaaaugcagcauuuggauucccaagaggugcaggaccagcaccuccaccagcaccaccagcugcaccagaaccucuaggaggaauaugugaacaugaaacaucuauagauauaucagcauauauagauccugcagcauucaaugaugaauuuuuagcagauuuauuucaacacucaagacaacaagaaaaagcaaaagcagcagcuggaccagcagguggaggaggagacuuugauuauccaggagcaccagcagguccuggcggagcaguaaugucagcaggagcacauggacccccuccuggauauggaugugcagcagcuggauauuuagacggaagauuagaaccauuauacgaaagaguaggagcaccugcauuaagaccauuaguaaucaaacaagaaccaagggaagaagaugaagcaaaacaauuagcauuagcuggauuauuuccauaucaaccaccaccaccaccaccaccaccacauccacaugcaucaccagcucauuuagcagcaccacaccuacaauuucaaauagcacauuguggacaaacuacuaugcauuuacaaccaggucauccaacaccaccaccaacaccaguaccaucaccacauccugcuccagcaaugggagcagcaggauuaccaggaccaggaggaucacuuaaagguuuagcaggaccacacccagaucuucgaacaggaggaggaggcggagguggugcaggagcaggaaaagccaaaaaaucaguugacaaaaauagcaaugaauacagaguaagacgagaaagaaauaauauagcaguaagaaaaagcagagauaaagcaaaacaaagaaauguagaaacacaacaaaaaguauuagaauuaacaucagacaaugaucguuuaagaaaacgaguagaacaacuuaguagagaauuagacacauuaagaggaauuuuuagacaauuaccagaaucaucauuaguaaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1262 - RNA, 1427 nt, Artificial Sequence
  mRNA product Design3 comprising derived and/or modified sequence from Mus musculus__NP_031704.2 __MmCebpa (opt6)
gggagagucccgcagucggcguccagcggcucugcuuguucgugugugugucguugcaggccuuauucaagcuuaccauggaaucagcagauuuuuaugaaguagaaccacgaccaccuaugaguucucacuuacaaaguccaccacacgcaccaucaaaugcugcauuuggcuucccuagaggcgcaggaccagcaccaccuccugcaccaccagccgcaccagaaccauuaggaggaauuugugaacaugaaacaucuauagauauaucagcauauauagacccagcagcauucaaugaugaauuuuuagcagaucuauuccaacacaguagacaacaagaaaaagcuaaagcagcagcaggaccagcaggaggaggcggagacuuugauuauccuggagcaccugcaggaccuggaggugcaguaaugucagcaggugcacaugguccaccaccuggauauggaugugcugcagcaggauaccuagauggaagauuagaaccacuauaugaaagaguuggugcaccugccuuaagaccauuagucauuaaacaagaaccaagagaagaagaugaagcaaaacaauuagcacuagcaggauuauucccauaucaaccaccacccccccccccaccaccacauccacaugcaucaccagcacauuuagcagcuccacauuuacaauuucaaauagcacauuguggccaaacaacuaugcauuugcaaccaggacauccaacaccaccaccaacaccagucccaucuccucacgcugcaccagcacuuggugcagcaggauuaccaggaccaggaagugcacuuaaaggauuggcaggagcccaucccgauuuaagaacaggaggagguggaggaggaaguggagcaggugcaggaaaagcaaaaaaaaguguagauaaaaauagcaacgaauauagaguacgaagagaaagaaauaauauagcaguaagaaaaucaagagauaaagcaaaacaaaggaauguugaaacacaacaaaaaguauuagaauuaacauccgauaaugacagauuacgaaaaagaguagaacaacucucaagagaauuagauacacuaagagguauauuuagacaauuaccagaaucaucauuaguuaaagcaaugggaaauugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1263 - RNA, 1385 nt, Artificial Sequence
  mRNA product Design3 comprising derived and/or modified sequence from Mus musculus__NP_031704.2 __MmCebpa(15-359) (opt6)
gggagagucccgcagucggcguccagcggcucugcuuguucgugugugugucguugcaggccuuauucaagcuuaccaugucuagccauuuacaaucaccaccacaugcaccaucaaaugcugcauuuggcuuucccagaggagcagguccugcaccacccccagcuccuccagccgcuccugaaccauuaggaggaauaugugaacaugaaacaucaauagacauuucagcauauauagacccagcagcauuuaaugaugaauuucuagcagauuuauuucaacacagcagacaacaagaaaaagccaaagcagcagcaggaccagcaggaggugguggagauuuugauuacccaggcgcaccagcaggucccggaggugcaguuaugucagccggagcucauggaccaccaccuggcuacggcugugcagcagcaggauauuuagacgguagacuagaaccauuauacgaaagaguaggagccccagcacuaagaccauuaguaauaaaacaagaaccaagagaagaagaugaagcaaaacaauuagcauuagcuggauuauuuccauaucaaccaccaccuccaccuccaccaccacauccccaugcuucaccagcacaucuugcagcaccacauuuacaauuucaaauagcucauuguggacaaacaacaaugcaccuacaaccaggacacccaacaccaccaccuacuccaguaccauccccacaugcugcaccagcacuaggagcagcuggccuuccaggcccaggaucugcacuuaaaggauuagcaggagcucauccggauuuaagaacaggaggaggaggaggaggaucaggagcaggagcagguaaagcuaaaaaaucaguagauaaaaauucaaacgaauacagaguaagacgagaacgaaauaacauagccguaagaaaaucaagagauaaagcaaaacaaagaaacguagaaacacaacaaaaaguauuagaacuaacaagugauaaugaucgacuaagaaaaagaguagaacaacuaucaagagaauuagauacacuucguggaauauuuagacaauuaccagaaucaucauuaguuaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1264 - RNA, 1424 nt, Artificial Sequence
  mRNA product Design3 comprising derived and/or modified sequence from Homo sapiens__NP_004355.2__HsCEBPA (opt6)
gggagagucccgcagucggcguccagcggcucugcuuguucgugugugugucguugcaggccuuauucaagcuuaccauggaaucagcagauuuuuacgaagcagaaccaagacccccaaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1265 - RNA, 1382 nt, Artificial Sequence
  mRNA product Design3 comprising derived and/or modified sequence from Homo sapiens__NP_004355.2__HsCEBPA(15-358) (opt6)
gggagagucccgcagucggcguccagcggcucugcuuguucgugugugugucguugcaggccuuauucaagcuuaccaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1266 - RNA, 1772 nt, Artificial Sequence
  mRNA product Design3 comprising derived and/or modified sequence from Homo sapiens__NP_000448.3__HsHNF4A (opt6)
gggagagucccgcagucggcguccagcggcucugcuuguucgugugugugucguugcaggccuuauucaagcuuaccaugcgauuaucaaaaacacucguagauauggauauggcggacuacucagcagcauuagaccccgcauauaccacauuagaauuugaaaacguccaaguauuaacaaugggaaaugacacaucucccucagaaggaacaaaccucaacgcaccaaacucucuaggaguaucagcucuaugcgccauaugcggagaccgagccacaggaaaacacuacggagcaucaucaugugacgguugcaaaggauucuucagaagaucuguaagaaaaaaucacauguacucaugcagauucucuagacaaugcguugucgacaaagacaaaagaaaucaaugcagauacugcagacugaaaaaaugcuucagagcaggaaugaaaaaagaagcaguacaaaacgaaagagauagaauuuccacacguagaucuucauaugaagacuccucauuaccaucaauaaaugcacuauuacaagcagaaguacuaucacgacaaauaaccucccccguaucaggaauuaacggagauauaagagcaaaaaaaauagcaucaauagccgauguaugcgagagcaugaaagaacaacuauuaguacuuguagaaugggcaaaauacaucccagcuuuuugcgaauuaccguuagaugaccaaguagcauuauuaagagcacacgcaggagaacaucuauuacucggugcaacaaaaagauccaugguauucaaagacguccuacuucuaggaaacgacuacauaguaccacgccacugccccgaauuagcagaaauguccagaguuaguauaagaauacuagacgaauuaguacuaccauuccaagaacuacaaauagaugacaacgaauaugcauauuuaaaagcaaucaucuucuucgauccagacgcaaaaggacuauccgauccugguaaaauaaaaagguuaagaucacaaguacaaguaucacuugaggauuacaucaacgauagacaauacgacucacgagguagguuuggagaacuauuacuuuuauuaccaaccuuacaaucaaucacauggcaaaugauagaacaaauacaauucaucaaacuauucggaauggccaaaauagacaaccuacuacaagaaauguuauuaggaggaucaccaucugacgcaccacacgcacaccauccacuacacccacaucuaaugcaagaacacauggguacaaacguaauagucgcaaauacaaugccaacacaccuaucuaacggacaaaugugcgaauggccacgcccacgaggacaagcagcaacaccugaaaccccacaaccaucaccacccggagguucaggaucagaaccauacaaacuccuaccuggagcaguagcaacaauaguaaagccauuaucagcaauaccacaaccaacaauaacaaaacaagaaguaauauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1267 - RNA, 977 nt, Artificial Sequence
  mRNA product Design3 comprising derived and/or modified sequence from Homo sapiens__NP_061986.1__HsFGF21 (opt6)
gggagagucccgcagucggcguccagcggcucugcuuguucgugugugugucguugcaggccuuauucaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1268 - RNA, 1703 nt, Artificial Sequence
  mRNA product Design3 comprising derived and/or modified sequence from Homo sapiens__NP_078852.3__HsOGFRL1 (opt6)
gggagagucccgcagucggcguccagcggcucugcuuguucgugugugugucguugcaggccuuauucaagcuuaccaugggaaauuuauuagguggaguauccuucagagaaccaacaacagucgaagacugugacagcacauggcaaacggacucagaaccagaaccagaagaaccaggaccaggaggaggaucagaaggaccaggucaagaaucagaacaaccagcacaaccaccagaacaagcaggaggaagaccaggugcauccccagccccagacgaagacgcagaagcagccggagcagaacaaggaggugacaguacagaagcuaccgcaaaacccaaacgaucauucuacgcagcaagagaccuuuacaaauacagacaccaguauccaaacuucaaagacauuagauaccaaaaugauuuaagcaaccuacgauuuuauaaaaauaaaauaccauucaaacccgacggagucuacauagaagaaguacuaucaaaauggaaaggcgauuacgaaaaauuagaacauaaccacacauacauacaaugguuauucccacucagagaacaaggauuaaauuuuuaugcaaaagaacuuacaacauacgaaauagaagaauuuaaaaaaacaaaagaagcaauacgcagauuccuacuggcauacaaaaugaugcuagaauuuuucggcauaaaauuaacagacaaaaccggcaacguagcaagagcaguaaacuggcaagaacgauuccaacaucuaaacgaaagccaacacaacuaccugagaauaacacgcauacuaaaaucacuaggagaacuaggcuaugaauccuuuaaaagcccauuaguaaaauucauacuacaugaagccuuaguagaaaacacaauaccaaacauaaaacaaucagcauuagaauacuucguauauacaauaagagacagaagagaaagaagaaagcuauuacgauuugcacaaaaacauuacacacccucagaaaacuucaucuggggcccaccaagaaaagaacaaucagaaggaucaaaagcacaaaaaaugagcucaccacuagcaaguucacauaacucacaaacauccaugcauaaaaaagcaaaagauucaaaaaauuccucaucagcaguacaccuaaacaguaaaacugccgaagacaaaaaaguagcaccaaaagaaccaguagaagaaacagacagacccucaccugaaccuagcaacgaagcagcaaaaccaagaaauacagaaaaagauucaaacgcagaaaauaugaacucacaaccagaaaaaacugucaccacaccaacagaaaaaaaagaaucaguaucaccagaaaauaacgaagaaggaggcaacgauaaccaagacaacgaaaacccagguaacacaaacugucacgacgucguauuaguucaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1269 - RNA, 905 nt, Artificial Sequence
  mRNA product Design3 comprising derived and/or modified sequence from Homo sapiens__NP_008842.1__HsRLN1 (opt6)
gggagagucccgcagucggcguccagcggcucugcuuguucgugugugugucguugcaggccuuauucaagcuuaccaugccaagacuauucuuauuccaccuauuagaauuuugccuacuacuaaaccaauuuuccagagcaguagcagcaaaauggaaagacgacguaauaaaauuaugcggaagagaacucguaagagcacaaauagcaauaugcggaaugucaacauggucaaaaagaucacuaucacaagaagacgcaccacaaacaccaagaccaguagcagaaauagucccaucauucauaaacaaagacacagaaacaauaauaauaaugcuagaauuuauagcaaacuuaccacccgaacuaaaagcagcacuaucagaaagacaaccaucacuaccagaacuacaacaauacgucccagcacuaaaagacucaaaccuauccuucgaagaauuuaaaaaacucauaagaaacagacaaucagaagcagcagacucaaacccauccgaacuaaaauaccuaggacuagacacacacucacaaaaaaaaagaagaccauacguagcccuauucgaaaaaugcugccuaauaggauguacaaaacgcucacuagcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1270 - RNA, 905 nt, Artificial Sequence
  mRNA product Design3 comprising derived and/or modified sequence from Homo sapiens__NP_604390.1__HsRLN2 (opt6)
gggagagucccgcagucggcguccagcggcucugcuuguucgugugugugucguugcaggccuuauucaagcuuaccaugccaagacuauucuucuuccaccuacuaggaguaugccuacuccuaaaccaauucuccagagcaguagcagacucauggauggaagaaguaauaaaacuaugcggaagagaacuuguaagagcacaaauagcaauaugcggaauguccacauggucaaaaagaucacuaucacaagaagacgcaccacaaacaccaagaccaguagcagaaauaguaccaucauucauaaacaaagauacagaaacaauaaacaugaugucagaauuugucgcaaaccuaccacaagaauuaaaacuaacauuaucagaaaugcaaccagcccuaccacaacuacaacaacacguacccguacuaaaagacucaucauuacuauucgaagaauuuaaaaaacuaauaagaaacagacaaucagaagcagcagacagcucaccaucagaauuaaaauaccucggacuagacacacacucaagaaaaaaaagacaauuauacucagcacuagcaaacaaaugcugccacguaggaugcacaaaaagaucacuagccagauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1271 - RNA, 776 nt, Artificial Sequence
  mRNA product Design3 comprising derived and/or modified sequence from Homo sapiens__NP_543140.1__HsRLN3  (opt6)
gggagagucccgcagucggcguccagcggcucugcuuguucgugugugugucguugcaggccuuauucaagcuuaccauggcaagauauauguuauuauuauuauuagcaguauggguacuaacaggagaauuauggccaggagcagaagcaagagcagcaccauauggaguaagauuguguggaagagaauuuauaagagcaguaauauuuacauguggaggaagcagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaggcauuuuauagaggaagaccaaguuggcaaggaacaccaggaguauuaagaggaagcagagauguauuagcaggauuaaguaguaguuguuguaaauggggauguaguaaaagugaaauaaguaguuuauguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1272 - RNA, 1757 nt, Artificial Sequence
  mRNA product Design3 comprising derived and/or modified sequence from Homo sapiens__NP_002412.1__HsMMP1 (opt6)
gggagagucccgcagucggcguccagcggcucugcuuguucgugugugugucguugcaggccuuauucaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1273 - RNA, 1517 nt, Artificial Sequence
  mRNA product Design3 comprising derived and/or modified sequence from Homo sapiens__NP_002412.1__HsMMP1(1-19,100-469) (opt6)
gggagagucccgcagucggcguccagcggcucugcuuguucgugugugugucguugcaggccuuauucaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1274 - RNA, 3704 nt, Artificial Sequence
  mRNA product Design3 comprising derived and/or modified sequence from Clostridium histolyticum__BAA77453.1__ColG (opt6)
gggagagucccgcagucggcguccagcggcucugcuuguucgugugugugucguugcaggccuuauucaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1275 - RNA, 3428 nt, Artificial Sequence
  mRNA product Design3 comprising derived and/or modified sequence from Clostridium histolyticum__BAA77453.1__HsALB(1-18)_ColG(111-1118) (opt6)
gggagagucccgcagucggcguccagcggcucugcuuguucgugugugugucguugcaggccuuauucaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1276 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt6)
gggagagucccgcagucggcguccagcggcucugcuuguucgugugugugucguugcaggccuuauucaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1277 - RNA, 3452 nt, Artificial Sequence
  mRNA product Design3 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1278 - RNA, 3413 nt, Artificial Sequence
  mRNA product Design3 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1279 - RNA, 3347 nt, Artificial Sequence
  mRNA product Design3 comprising derived and/or modified sequence from Clostridium histolyticum__BAA34542.1__HsALB(1-18)_ColH(41-1021) (opt6)
gggagagucccgcagucggcguccagcggcucugcuuguucgugugugugucguugcaggccuuauucaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1280 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt6)
gggagagucccgcagucggcguccagcggcucugcuuguucgugugugugucguugcaggccuuauucaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1281 - RNA, 1193 nt, Artificial Sequence
  mRNA product Design3 comprising derived and/or modified sequence from Homo sapiens__NP_003801.1__HsTNFSF10 (opt7)
gggagagucccgcagucggcguccagcggcucugcuuguucgugugugugucguugcaggccuuauucaagcuuaccauggccaugauggaggugcagggcgggcccagccugggucaaaccugcguccucaucgugauuuucacuguacuguugcagucccuguguguggcagucaccuacguguauuuuacgaacgaacucaagcagaugcaggacaaauacaguaagagcggcaucgccugcuuccugaaagaggaugacuccuauugggauccaaaugacgaagagaguaugaacagcccguguuggcaagugaaguggcaguugaggcagcugguccggaaaaugauucuccgcacuuccgaagagaccaucagcaccgugcaggagaagcaacagaauauuaguccccugguaagggaacgggggccacagcgcguggcggcccacaucacuggcaccaggggucgguccaacacgcugagcucccccaauagcaagaacgagaaagcacucgggcgcaagaucaauaguugggaauccagcagguccggccauaguuuucugagcaacuugcaucugcggaauggcgagcucgucauucacgagaaaggguucuacuauaucuacucccagacuuauuuucgcuuccaagaagagauuaaggaaaacaccaaaaaugauaagcagauggugcaguacaucuacaaauauacuagcuacccagaccccauucugcugaugaagagugccaggaacuccugcuggagcaaggaugcagaguaugguuuguacaguaucuaucaaggcgggauuuuugaacucaaagagaaugaccggaucuucguguccgucaccaacgagcaccugaucgauauggaccaugaagccagcuuuuucggcgcguuucugguggguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1282 - RNA, 914 nt, Artificial Sequence
  mRNA product Design3 comprising derived and/or modified sequence from Homo sapiens__NP_003801.1__HsTNFSF10(95-281) (opt7)
gggagagucccgcagucggcguccagcggcucugcuuguucgugugugugucguugcaggccuuauucaagcuuaccaugaccagcgaggaaacuaucuccaccgugcaggagaagcaacagaacauuaguccccuggucagggaacggggcccacagcgcguggccgcacacaucacggggacuaggggucggagcaauacccucuccaguccgaacagcaaaaaugagaaggcccugggccgcaaaauuaacuccugggaaagcuccaggagugggcauagcuucuuguccaaucugcaccuccggaacggcgagcugguaauccaugagaaggguuuuuacuauauuuacagccagaccuauuuccgcuuucaagaagagaucaaagaaaauacuaagaacgacaagcagauggugcaguacaucuauaaauacaccaguuaucccgauccaauuuugcugaugaaguccgcgaggaauagcugcugguccaaagacgccgaguacgggcucuacaguaucuaucagggcggcauuuucgagcugaaggaaaacgaucggaucuuugucagcgugacgaaugagcaccugauugacauggaucaugaagcauccuucuuuggggccuuccucguggguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1283 - RNA, 965 nt, Artificial Sequence
  mRNA product Design3 comprising derived and/or modified sequence from Homo sapiens__NP_003801.1__HsALB(1-18)_HsTNFSF10(95-281) (opt7)
gggagagucccgcagucggcguccagcggcucugcuuguucgugugugugucguugcaggccuuauucaagcuuaccaugaagugggugaccuucaucagccugcucuuucuguucuccagugccuacagcacuuccgaggaaaccauuaguacgguccaggagaaacaacagaacaucagccccuuggugagggaacggggcccacagcgcguagcagcccacauuacugggaccaggggucgguccaauacccugagcuccccgaacaguaagaaugagaaagcgcucggccgcaagaucaacagcugggaauccagcaggagugggcauuccuuucugagcaauuugcaucugcggaacggcgagcucgugauucacgagaaagguuucuauuacaucuauucccagacuuacuuucgcuuccaagaagagaucaaggaaaauaccaagaacgacaaacagaugguccaguauauuuacaaguauacgaguuaccccgauccaauccugcugaugaaaagcgccaggaacuccugcuggagcaaggacgcagaguacgggcucuauaguauuuaccagggcggcaucuuugagcugaaagaaaaugaucggauuuucguguccgugacuaaugagcacuugaucgacauggaucaugaagccagcuuuuucggggcauuucuggucgguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1284 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt7)
gggagagucccgcagucggcguccagcggcucugcuuguucgugugugugucguugcaggccuuauucaagcuuaccaugaagugggugaccuucaucagccugcucuuucuguucuccagugccuacagcaggaugaaacagauugaggacaagaucgaagagauuuuguccaaaaucuaucacauugaaaacgagaucgcacggaucaagaaacugauuggcgaaaccagugaggagacuaucagcacgguccaagaaaagcagcagaauauuaguccccucgugcgcgagagggggccacagcggguagccgcgcauaucacugguacccgcggcaggagcaacacccuguccaguccgaauagcaagaacgaaaaagccuuggggcggaagauuaauuccugggagagcagucgcuccggccacagcuuucuguccaaccuccaucugaggaauggugagcuggugauccacgaaaaaggguucuacuauauuuacagucaaacuuauuuucgguuccaggaggaaaucaaggagaacaccaaaaaugauaagcagaugguccaguacaucuauaaauacacgagcuaccccgacccaauucuccugaugaaguccgcacgcaacagcugcuggaguaaggaugccgaauauggcuuguacuccaucuaucaaggcgggauuuuugagcugaaagagaaugacaggaucuucgugagcgugacuaacgaacaucucauugauauggaccacgaggcauccuuuuucggugccuuucuggucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1285 - RNA, 1424 nt, Artificial Sequence
  mRNA product Design3 comprising derived and/or modified sequence from Rattus norvegicus__NP_036656.1__RnCebpa (opt7)
gggagagucccgcagucggcguccagcggcucugcuuguucgugugugugucguugcaggccuuauucaagcuuaccauggagagcgccgacuucuacgaagcagagcccaggccaccgauguccagucaucugcagagcccaccccacgcccccuccaacgcggccuuuggcuucccccgcggggcaggucccgccccaccgcccgcaccacccgccgcgccagaaccccucggcgggaucugcgagcacgaaaccaguauugauaucagcgccuauauugacccggcagccuuuaaugaugaguuccuggccgacuuguuucaacauucccggcagcaggagaaggcaaaagccgcggccggccccgccggugggggcggcgauuucgacuacccaggggcccccgcagguccaggcggggccgugaugagcgccggcgcgcacggucccccaccgggguauggcugugcagccgccggcuaccuggaugggaggcucgaaccccuguaugagcgggucggugcaccagccuugcgcccccuggugaucaagcaggaaccaagggaggaggacgaagcgaaacaacucgcccuggcaggccuguuucccuaccagccgccaccacccccacccccaccgcauccccacgccuccccagcacaccucgccgcaccccaucugcaguuccagauugcacacugcgggcaaacuaccaugcauuugcagccaggccaccccacgccgccacccacuccaguacccaguccgcaccccgccccagcgaugggugccgcaggccugcccgggccaggcgggagccucaagggucuggccggcccccauccagaucugcggaccgggggcgguggcgggggcggggccggcgcagguaaagcgaagaaguccguggacaaaaacagcaaugaguaucgcgucaggcgggaacgcaacaauaucgccgugaggaagagucgggauaaagcaaagcagcgcaacguggagacccagcaaaaagucuuggaacucacuuccgacaaugauaggcugcggaagcgcguggagcagcugagcagggagcucgacacccugcgggggaucuuucgccaguugccggaauccagucugguaaaagccaugggcaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1286 - RNA, 1382 nt, Artificial Sequence
  mRNA product Design3 comprising derived and/or modified sequence from Rattus norvegicus__NP_036656.1__RnCebpa(15-344) (opt7)
gggagagucccgcagucggcguccagcggcucugcuuguucgugugugugucguugcaggccuuauucaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacccagcccccgcaaugggugccgcgggccugccggggcccggcgggagucucaagggucuggccggcccacaucccgaccugaggaccgggggcgguggcgggggcggggcaggcgccgguaaagccaaaaagagcguggauaagaacuccaaugaguaccggguccgcagggagcggaacaauaucgcagugcgcaagagcagggacaaagcgaagcagcggaacguggaaacccagcaaaaagucuuggagcucacuuccgauaaugaccgccugaggaagcggguggaacagcugucccgcgagcucgauacccugagggggaucuuccggcaguugccagaaagcucccugguaaaagccaugggcaacugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1287 - RNA, 1427 nt, Artificial Sequence
  mRNA product Design3 comprising derived and/or modified sequence from Mus musculus__NP_031704.2 __MmCebpa (opt7)
gggagagucccgcagucggcguccagcggcucugcuuguucgugugugugucguugcaggccuuauucaagcuuaccauggagagcgccgacuucuacgaaguggagcccaggccaccgauguccagucaucugcagagcccaccccacgcacccuccaacgccgcguuuggcuucccccgcggggccggucccgcaccaccgcccgccccacccgcagccccagaaccccucggcgggaucugcgagcacgaaaccaguauugauaucagcgcguauauugacccggccgcauuuaaugaugaguuccuggccgacuuguuucaacauucccggcagcaggagaaggccaaagcagccgcgggccccgccggugggggcggcgauuucgacuacccaggggcacccgccgguccaggcggggcagucaugagcgccggcgcccacggucccccaccgggguauggcugugcggcagccggcuaccuggaugggaggcucgaaccccuguaugagcgggugggugccccagcauugcgcccccugguaaucaagcaggaaccaagggaggaggacgaagccaaacaacucgcgcuggccggccuguuucccuaccagccgccaccacccccacccccaccgcauccccacgcauccccagcccaccucgcagcaccccaucugcaguuccagauugcccacugcgggcaaacuaccaugcauuugcagccaggccaccccacgccgccacccacuccagugcccaguccgcacgccgcccccgcgcugggugccgcaggccucccagggcccggcagcgcccugaaggggcuggccggugcacauccagauuugcggaccggcgggggcgguggcggguccggcgcgggggccggcaaagcaaagaaaagcgucgacaagaacaguaaugaguaucgcgugaggcgggaacgcaacaauaucgccgugaggaagucccgggauaaagccaagcagcgcaacgucgagacccagcaaaaagugcucgaacugacuagcgacaaugauaggcugcggaagcgcguagagcagcucuccagggagcuggacaccuugcgggguaucuuucgccagcugcccgaaaguagccucgugaaagcaauggggaacugugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1288 - RNA, 1385 nt, Artificial Sequence
  mRNA product Design3 comprising derived and/or modified sequence from Mus musculus__NP_031704.2 __MmCebpa(15-359) (opt7)
gggagagucccgcagucggcguccagcggcucugcuuguucgugugugugucguugcaggccuuauucaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacgccgcaccagcccugggugcggccggccuccccgggccgggcuccgcacugaaggggcuggccggugcccaucccgacuugaggaccggcgggggcgguggcgggagcggcgcaggggcgggcaaagccaagaaguccguggauaaaaacagcaaugaguaccggguccgcagggagcggaacaauaucgcagugcgcaagaguagggacaaagccaagcagcggaacguggaaacccagcaaaaaguccucgagcugacuuccgauaaugaccgccugaggaagcggguggaacagcucagccgcgagcuggauaccuugagggguaucuuccggcagcugccagaauccagucucguaaaagccauggggaacugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1289 - RNA, 1424 nt, Artificial Sequence
  mRNA product Design3 comprising derived and/or modified sequence from Homo sapiens__NP_004355.2__HsCEBPA (opt7)
gggagagucccgcagucggcguccagcggcucugcuuguucgugugugugucguugcaggccuuauucaagcuuaccauggagagcgccgacuucuacgaagcagagcccaggccaccgauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1290 - RNA, 1382 nt, Artificial Sequence
  mRNA product Design3 comprising derived and/or modified sequence from Homo sapiens__NP_004355.2__HsCEBPA(15-358) (opt7)
gggagagucccgcagucggcguccagcggcucugcuuguucgugugugugucguugcaggccuuauucaagcuuaccauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1291 - RNA, 1772 nt, Artificial Sequence
  mRNA product Design3 comprising derived and/or modified sequence from Homo sapiens__NP_000448.3__HsHNF4A (opt7)
gggagagucccgcagucggcguccagcggcucugcuuguucgugugugugucguugcaggccuuauucaagcuuaccaugaggcugagcaagacccucguggacauggauauggccgacuacuccgcagcccuggaucccgcguauacuaccuuggaguucgaaaacguccaggugcugacgaugggcaaugacacuagcccaagcgaggggaccaaccucaaugccccgaacucccuggguguaagugcauugugcgccaucuguggcgaucgggcaaccgggaaacacuacggcgccagcuccugcgacgguuguaagggguuuuuccgcaggagcgugcggaaaaaucauauguauuccugccgcuuuaguaggcaaugugucguggauaaggacaaacggaaccagugccgcuacuguaggcugaagaagugcuuccgggcgggcaugaaaaaggaagccgugcagaaugagcgcgauaggauuagcacucggcgcuccagcuaugaagacaguucccuccccagcaucaacgcacugcugcaggccgagguccucuccaggcaaauuaccaguccagugagcggcaucaauggggauauucgggccaaaaagaucgcauccaucgccgacguaugugagagcaugaaagaacagcuguuggugcuggucgagugggcgaaguacauucccgccuuuugcgaacucccacuggaugaccagguggcacuguugcgcgcccacgccggugagcaucuccugcugggcgcaacgaaaaggaguaugguguucaaggacguccuccuguuggggaacgauuauaucgugccccggcacugcccagagcuggccgaaaugucccgcguaagcauuaggauccucgacgagcuggugcugccguuucaggaauugcaaauugaugacaaugaguacgcguaccucaaggcaaucauuuucuuugaucccgacgccaaaggccugagugauccagguaagaucaaacggcugaggucccagguccaggugagccucgaagacuauaucaacgaucgccaguacgacagccgggggagguucggcgagcuguugcugcuccugcccacucugcaauccauuaccuggcagaugaucgagcagauucaauuuaucaaguuguucggcauggccaaaauugauaaucuccugcaggaaaugcugcucggggguaguccaagcgacgcaccccaugcccaccacccgcugcauccccacuugaugcaggagcauaugggcacuaacgugaucgucgcgaauaccaugccaacccaccuguccaacgggcagaugugugaauggccccgcccacggggccaagccgcaacgcccgagacuccacagccgagucccccagguggcaguggguccgaacccuauaagcuccugccaggcgccguggcaaccaucguaaagccccugagcgccauuccgcagccaacuaucaccaaacaggaggugauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1292 - RNA, 977 nt, Artificial Sequence
  mRNA product Design3 comprising derived and/or modified sequence from Homo sapiens__NP_061986.1__HsFGF21 (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1293 - RNA, 1703 nt, Artificial Sequence
  mRNA product Design3 comprising derived and/or modified sequence from Homo sapiens__NP_078852.3__HsOGFRL1 (opt7)
gggagagucccgcagucggcguccagcggcucugcuuguucgugugugugucguugcaggccuuauucaagcuuaccaugggcaaccugcucgggggugugagcuucagggagcccaccacugucgaagacugcgauuccaccuggcagacggacagugagccagaaccggaggaacccggcccagggggcgguagcgaggggcccggccaagaguccgaacagccagcccagcccccagagcaggcaggcgggcggccgggugccagucccgcgccagaugaagacgccgaggcagccggcgcagagcaagggggcgauagcacugaagccaccgcgaagcccaaacgcuccuuuuacgccgcaagggaccuguauaaguaccggcaccaguauccaaauuucaaagauauccgcuaccagaacgacuugagcaaucugagguuuuauaagaacaaaauucccuucaagccggaugguguguacaucgaggaaguacucuccaaguggaaaggggacuaugagaagcuggaacauaaucacaccuacauucagugguuguuuccccugcgggagcaaggccucaacuucuacgccaaagagcugacuaccuaugaaaucgaggaauuuaagaaaacgaaggaggccauucgcagguuccugcucgcauacaaaaugaugcuggaauuuuucggcaucaaguugacugauaagaccgggaauguggcccgggcggucaacuggcaggagcgcuuucagcaucugaaugagagucagcacaacuaucucaggaucacucggauucugaaaagccugggugaauugggcuacgaguccuucaagagcccacucgugaaauucauccugcaugaagcccugguggagaauaccauucccaacaucaagcaaagugcacucgaauauuuugucuacaccauucgcgacaggcgggagcgcaggaaacuguugcgguucgcccagaagcacuauacgccauccgagaauuuuaucugggggcccccacgcaaggaacagagcgagggcuccaaagcacaaaagaugaguagcccgcuggccuccagccacaacagucagacuuccaugcauaaaaaggccaaagauagcaagaauaguuccagcgcggugcaccucaacagcaagaccgcagaagacaaaaagguagcccccaaagagccaguggaggaaacugacaggcccuccccagagcccaguaacgaagccgcaaagccgcggaauaccgagaaagauagcaacgccgaaaauaugaacucccagccagagaagaccgucacuacgcccaccgagaagaaagaaagcgugagucccgagaauaacgaagaggguggcaaugacaaccaggauaaugaaaacccagggaauacuaacugucaugacgugguccuggugcaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1294 - RNA, 905 nt, Artificial Sequence
  mRNA product Design3 comprising derived and/or modified sequence from Homo sapiens__NP_008842.1__HsRLN1 (opt7)
gggagagucccgcagucggcguccagcggcucugcuuguucgugugugugucguugcaggccuuauucaagcuuaccaugcccaggcuguuccucuuucaccuguuggaguucugccugcuccugaaccaguuuagccgggccguggcagccaaguggaaagacgaugucaucaaguuguguggccgcgaacuggugagggcgcaaauugccaucugcgggauguccaccuggaguaaacggagccucucccaggaggacgcaccacagacuccgcgccccguagccgaaauugugccaaguuucaucaauaaggauaccgagacgauuaucaucaugcuggaauuuauugcaaaccugcccccagagcucaaagccgcgcugagcgagaggcagcccuccuugccagaacugcaacaguacgucccggcccucaaggacagcaaucuguccuucgaggaauuuaagaaacugauccggaaccgccagagugaggcagccgauagcaaucccuccgaguugaaguaucucggucuggacacucauagccagaaaaagaggcggccauacguggcccuguucgaaaaauguugccucauuggcuguaccaagcgcagucuggcaaaauauugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1295 - RNA, 905 nt, Artificial Sequence
  mRNA product Design3 comprising derived and/or modified sequence from Homo sapiens__NP_604390.1__HsRLN2 (opt7)
gggagagucccgcagucggcguccagcggcucugcuuguucgugugugugucguugcaggccuuauucaagcuuaccaugcccaggcuguucuuuuuccaccuccugggcgugugcuugcugcucaaccaguuuagccgggccgucgcagacuccuggauggaggaagugaucaagcugugugggcgcgaguugguaagggcccaaauugcgaucugcgguaugaguaccuggagcaaacggucccugagucaggaagaugccccacagacuccgcgccccguggcagagauuguccccagcuucaucaauaaggacaccgaaacgauuaacaugauguccgaguuuguggccaaucucccacaggagcugaaacugacucucagcgaaaugcaaccagcacugccccaguugcagcagcaugugccaguccugaaggauuccagucuccuguucgaggaauuuaaaaagcugaucaggaaccggcaaagcgaggccgcggacuccagcccgagugaguugaaguaccucggccuggauacccacucccgcaaaaagaggcagcuguauagcgcccucgcaaauaaauguugccaugugggguguaccaagcggucccuggcccgcuucugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1296 - RNA, 776 nt, Artificial Sequence
  mRNA product Design3 comprising derived and/or modified sequence from Homo sapiens__NP_543140.1__HsRLN3  (opt7)
gggagagucccgcagucggcguccagcggcucugcuuguucgugugugugucguugcaggccuuauucaagcuuaccauggccagguacaugcugcuccuguugcuggcaguguggguccucaccggcgagcuguggcccggggccgaagcgcgggccgcaccauauggugugcgcuugugcggcagggaguucauccgggccguaauuuuuacuugugggggcagccgcuggaggcgguccgacauccuggcacacgaagccaugggugauaccuucccggacgcggaugccgacgaggauagucucgcaggggaacuggacgaggccaugggcagcuccgaguggcuggcccucacgaagaguccccaggcauuuuaccgcggcaggccaagcuggcaagggacucccggugugcugcggggcucccgcgaugucuuggccgggcugagcuccaguugcuguaaauggggcugcagcaaguccgaaauuagcagucucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1297 - RNA, 1757 nt, Artificial Sequence
  mRNA product Design3 comprising derived and/or modified sequence from Homo sapiens__NP_002412.1__HsMMP1 (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1298 - RNA, 1517 nt, Artificial Sequence
  mRNA product Design3 comprising derived and/or modified sequence from Homo sapiens__NP_002412.1__HsMMP1(1-19,100-469) (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1299 - RNA, 3704 nt, Artificial Sequence
  mRNA product Design3 comprising derived and/or modified sequence from Clostridium histolyticum__BAA77453.1__ColG (opt7)
gggagagucccgcagucggcguccagcggcucugcuuguucgugugugugucguugcaggccuuauucaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1300 - RNA, 3428 nt, Artificial Sequence
  mRNA product Design3 comprising derived and/or modified sequence from Clostridium histolyticum__BAA77453.1__HsALB(1-18)_ColG(111-1118) (opt7)
gggagagucccgcagucggcguccagcggcucugcuuguucgugugugugucguugcaggccuuauucaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1301 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1302 - RNA, 3452 nt, Artificial Sequence
  mRNA product Design3 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1303 - RNA, 3413 nt, Artificial Sequence
  mRNA product Design3 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1304 - RNA, 3347 nt, Artificial Sequence
  mRNA product Design3 comprising derived and/or modified sequence from Clostridium histolyticum__BAA34542.1__HsALB(1-18)_ColH(41-1021) (opt7)
gggagagucccgcagucggcguccagcggcucugcuuguucgugugugugucguugcaggccuuauucaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1305 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1306 - RNA, 1193 nt, Artificial Sequence
  mRNA product Design3 comprising derived and/or modified sequence from Homo sapiens__NP_003801.1__HsTNFSF10 (opt8)
gggagagucccgcagucggcguccagcggcucugcuuguucgugugugugucguugcaggccuuauucaagcuuaccauggccaugauggaaguacaaggaggccccucacucggccaaaccugcguccucaucguaaucuucaccguccuccuccaaucccucugcgucgcgguaacauacgucuacuucacaaacgaacucaaacaaaugcaagacaaauacuccaaauccggaaucgccugcuuucuaaaagaagacgacuccuacugggaccccaacgacgaagaaagcaugaacucccccuguuggcaagucaaauggcaacuccgccagcucguccgaaaaaugauacuacgcaccuccgaagaaacuaucuccaccguccaagagaaacaacaaaacaucuccccacugguccgagaacgaggcccccaacgcguagccgcccacaucacuggcacacgaggacgcuccaacacccuaucaucccccaacuccaaaaacgaaaaagcccuaggccgcaaaaucaacucaugggagucaucccgauccggccacuccuuccucuccaaccuacaccuacgcaacggagaacucgucauacacgaaaaaggauucuacuacauauauucccaaaccuacuuccgcuuccaagaggaaauaaaagaaaacaccaaaaacgacaaacaaaugguccaauacauauacaaauacacauccuaccccgaccccauacuccucaugaaauccgcccgcaacucuugcugguccaaggacgcagaauacggacucuacucaaucuaccaaggcggaauauucgaacucaaagaaaacgaccgcaucuucguaucaguaaccaacgagcaccucaucgacauggaccacgaagccuccuucuucggcgccuuccucguaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1307 - RNA, 914 nt, Artificial Sequence
  mRNA product Design3 comprising derived and/or modified sequence from Homo sapiens__NP_003801.1__HsTNFSF10(95-281) (opt8)
gggagagucccgcagucggcguccagcggcucugcuuguucgugugugugucguugcaggccuuauucaagcuuaccaugacaucagaagaaaccaucuccacaguccaagaaaaacaacaaaacaucucaccccuaguacgcgaacgcggcccacaacgcguagccgcacacaucaccggcacccgcggaagauccaacacccucuccucccccaacuccaaaaacgaaaaagcccucggccgaaaaaucaacuccugggaauccagccgaucaggccacucauuccucucaaaccuacaccuccgaaacggcgaacucguaauccacgaaaaaggcuucuacuacaucuacucccaaaccuacuuccgcuuccaagaagaaauaaaagaaaacaccaaaaacgacaaacaaaugguccaauacaucuacaaauacaccuccuacccagaccccauccuacuaaugaaauccgcacgaaacuccugcuggucaaaagacgccgaauacggacucuacuccaucuaccaaggcggaaucuucgaacucaaagaaaacgaccgcaucuucgucagcguaaccaacgaacaccucaucgacauggaccacgaagccagcuucuucggagccuuccuagucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1308 - RNA, 965 nt, Artificial Sequence
  mRNA product Design3 comprising derived and/or modified sequence from Homo sapiens__NP_003801.1__HsALB(1-18)_HsTNFSF10(95-281) (opt8)
gggagagucccgcagucggcguccagcggcucugcuuguucgugugugugucguugcaggccuuauucaagcuuaccaugaaaugggucaccuucaucucccuccuauuccuauucucaucagcauacuccaccagcgaagaaaccaucuccaccguccaagaaaaacaacaaaacaucuccccacucguccgcgaacgcggcccacaacgcgucgccgcccacaucaccggaacccgcggacgauccaacacacuauccucacccaacuccaaaaacgaaaaagcccucggacgcaaaauaaacucaugggaaucaucacgcucaggacacucauuccuguccaaccuccaccuacgaaacggcgaacucgucauccacgaaaaaggauucuacuacauauacucacaaaccuacuuccgcuuccaagaagaaaucaaagaaaacaccaaaaacgacaaacaaaugguccaauacaucuacaaauacaccuccuaccccgaccccauacuacucaugaaaucagcacgaaacuccugcugguccaaggacgccgaauacggccucuacuccauauaccaaggcggcaucuucgaacucaaagaaaacgaccguaucuucguaucaguaaccaacgaacaccucaucgacauggaccacgaagccuccuucuucggagccuuccuagucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1309 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt8)
gggagagucccgcagucggcguccagcggcucugcuuguucgugugugugucguugcaggccuuauucaagcuuaccaugaaaugggugaccuucaucucacuccuauuccuguucucgagcgcauacucgcgcaugaaacaaaucgaggacaaaaucgaagaaauacucucgaaaaucuaccacaucgagaacgaaaucgcacgcaucaaaaagcucauaggcgaaaccucggaagaaaccauaagcacgguccaagaaaagcaacaaaacauaagcccacucguacgcgagcgcggaccccagcgcguggccgcacacauaaccgggaccaggggaagauccaacacccugagcucgcccaacagcaaaaacgaaaaagcgcucgggcgaaaaaucaacagcugggaauccuccaggagcgggcacucguuccuaagcaaccuccaccucagaaacggggaauuagucauacacgagaaaggguucuacuacauauacucacaaacauacuuccgcuuccaagaagaaauaaaagagaacacgaaaaaugacaaacaaaugguccaguauauauacaaauacacaagcuauccagauccaauacuccugaugaaaagcgcgcgcaacagcuguuggucaaaagaugccgaguacggccuauacuccauauaccagggcggaaucuucgaacucaaagaaaacgaucgcaucuucgugagcguaacaaacgaacaccucauagacauggaccacgaagcgagcuucuucggagccuuccucgugggauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1310 - RNA, 1424 nt, Artificial Sequence
  mRNA product Design3 comprising derived and/or modified sequence from Rattus norvegicus__NP_036656.1__RnCebpa (opt8)
gggagagucccgcagucggcguccagcggcucugcuuguucgugugugugucguugcaggccuuauucaagcuuaccauggaaagcgcagacuucuacgaagcagaaccccgcccccccauguccucccaccuccaaucccccccccacgccccuuccaaugcagcauucggcuucccccgcggagcaggacccgcacccccaccagccccccccgccgcccccgaaccccucggcggaauaugcgaacacgaaacauccaucgacauauccgcuuacauugaccccgccgccuucaacgacgaauuccucgcagaccucuuucaacacagccgccaacaggaaaaagcaaaagccgcagccggccccgccggcggcggaggcgacuucgacuaccccggcgccccagccggaccaggaggcgccgucauguccgcaggcgcccacggccccccccccggcuacggcugcgcugccgccggcuaccucgacggccgccucgaaccccucuacgaacgagucggagccccagcacuccgaccacucguaaucaaacaagaaccccgcgaagaagacgaagcgaaacaacuugcacucgcaggccuauuccccuaccaaccccccccaccccccccacccccccacccccacgcauccccagcccaccucgccgcaccccaccuccaauuccaaauagcccauugcggccaaaccaccaugcaccuccaaccaggccaccccaccccaccccccacacccguaccaucgccucacccagcccccgcaaugggcgccgccggccuaccuggcccaggcggcagccucaaaggacuugcaggcccacaccccgaccucagaacaggcggcggcggcggcggaggcgccggcgccggcaaagcaaaaaaaucagucgacaaaaacuccaacgaauaccgaguccgacgcgaacgcaacaacaucgccguccgcaaaucccgcgacaaagccaaacaaagaaacguagaaacacaacaaaaaguucucgaacuuacaucagacaaugacagacuucgcaaacgcgucgagcaacuaucccgcgaacucgacacccuccgagguaucuuccgacaacuccccgaauccucccucgucaaagccaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1311 - RNA, 1382 nt, Artificial Sequence
  mRNA product Design3 comprising derived and/or modified sequence from Rattus norvegicus__NP_036656.1__RnCebpa(15-344) (opt8)
gggagagucccgcagucggcguccagcggcucugcuuguucgugugugugucguugcaggccuuauucaagcuuaccauguccucccaccuccaaucccccccacacgcaccauccaacgccgccuucggcuuccccagaggcgccggccccgcccccccccccgccccccccgccgcccccgaaccccuaggcggcauaugcgaacacgaaaccuccaucgacaucucagccuacauagaccccgccgcauucaacgacgaauuccucgccgaccuuuuccaacacagccgucaacaagaaaaagccaaagccgccgccggaccagccggcggcggcggcgacuucgacuacccaggcgcccccgccggacccggcggcgccgucaugucagcaggagcccacggcccaccucccggcuacggaugcgccgcagcaggcuaccucgacggcagacuagaaccacuauacgaacgcgugggagcacccgcacuccgaccccucguaaucaaacaagaaccaagagaagaagacgaagccaaacaacucgcacucgccggccucuuccccuaccaaccacccccaccccccccacccccccacccccacgcauccccagcacaccuagccgccccccaccuucaauuccaaaucgcacacugcggccagacaacaaugcaccuccaacccggccaccccacacccccucccacccccgucccauccccccacccagcccccgcaaugggcgccgccggacuaccaggacccggcggaucccuaaaaggacucgccggcccccaccccgacuuacgcaccggcggcggcggcggcggaggcgccggggcaggcaaagccaaaaaauccgucgacaaaaacucaaacgaauacagaguacgccgagaacgaaauaacaucgccguccgaaagucacgcgacaaagcaaaacaacgaaacgucgaaacacaacaaaaaguacuagaacucaccuccgacaacgaccgacuacgaaaacgcgucgaacaacuuucacgcgaacucgacacccuccgcggaaucuuccgacaacuaccagaaucaucccuugucaaagccaugggaaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1312 - RNA, 1427 nt, Artificial Sequence
  mRNA product Design3 comprising derived and/or modified sequence from Mus musculus__NP_031704.2 __MmCebpa (opt8)
gggagagucccgcagucggcguccagcggcucugcuuguucgugugugugucguugcaggccuuauucaagcuuaccauggaauccgccgacuuuuacgaaguagaaccccgcccacccauguccucccaucugcaaucaccuccccacgcccccuccaacgccgcauucggauucccccgcggcgcaggacccgccccacccccagccccacccgcagcccccgaaccccucggcggcauuugcgaacacgaaaccuccaucgacaucucagccuacauagaccccgccgccuucaacgacgaguuccucgccgaccuuuuccaacacucccgccaacaagaaaaagccaaagcagccgccggccccgccggaggcggcggagacuucgacuaccccggcgcacccgccggacccggaggcgccgucaugucagcaggcgcccauggacccccacccggcuacggaugugcagccgccggauacuuagacggccgccuagaaccccucuacgaacgcguaggcgcccccgcccuucgcccccucguuaucaaacaagaaccccgcgaagaagacgaagccaaacaacuagcccuagccggccucuuccccuaccaacccccacccccacccccgccaccccacccccaugcaucccccgcccaccuagccgcuccccaccuacaauuccaaaucgcacacugcggccaaacaaccaugcacuuacaacccggccaccccacacccccacccacccccgucccgucaccccacgccgccccagcccuaggagccgccggccuccccggacccggcuccgcccuaaaaggacucgccggcgcccacccagaccuccgaacaggcggcggcgguggcggcuccggcgccggggcaggaaaagccaagaaauccguagacaaaaacuccaacgaauaccgcguccgacgcgaaagaaacaacaucgccguccgaaaaucccgcgacaaagcaaaacaaagaaacgucgaaacacaacaaaaaguccuagaacuaaccuccgacaacgaccgccuucguaaacgcguagaacaacuaucccgcgaacucgacacccuacgcggcaucuuccgccaacuccccgaaucaucccucguuaaagcaaugggcaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1313 - RNA, 1385 nt, Artificial Sequence
  mRNA product Design3 comprising derived and/or modified sequence from Mus musculus__NP_031704.2 __MmCebpa(15-359) (opt8)
gggagagucccgcagucggcguccagcggcucugcuuguucgugugugugucguugcaggccuuauucaagcuuaccaugucaagccaccuccaaucacccccccacgcccccucuaacgccgcauucgguuucccccgaggcgccgguccagccccacccccugcgcccccagccgccccagaaccccuuggaggaaucugcgaacacgaaaccuccauagacauaucagccuacaucgaccccgccgccuucaacgaugaauuccuagccgaccucuuccaacacucacgccaacaagaaaaagcaaaagccgccgccggcccagccggcggcggaggagacuucgacuacccaggcgcacccgcaggaccgggaggagccguaauguccgcaggcgcccacggcccaccccccggauacggaugcgcagccgccggcuaccucgacggacgacuagaaccacucuacgaaagagucggcgcccccgcccuacgcccccucguaauaaaacaagaaccccgagaagaagacgaagccaaacaacucgcccucgccggacucuuccccuaccaaccgccccccccccccccccccccacacccacacgcaucaccagcccaccuagcagccccccaccuacaauuccaaauagcccacugcggacaaaccaccaugcaccuacaaccaggccaccccaccccaccucccaccccagucccauccccacacgccgccccagcccucggcgccgccggacucccaggacccggcucagcccucaagggacuagccggagcacaccccgaccuccgaacaggcggaggaggcggcggcuccggagcuggugccggaaaagcaaaaaaauccgucgacaaaaacuccaacgaauacagaguccgccgagaacgaaacaacauagccguccgaaaaucccgagacaaagcaaaacaacgaaacgucgaaacccaacaaaaaguccuagaacuaaccucugacaacgaccgacuacgcaaacgagucgaacaacucagcagagaacucgacacccucagaggaauauuccgacaacuaccagaauccucccuagucaaagcuaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1314 - RNA, 1424 nt, Artificial Sequence
  mRNA product Design3 comprising derived and/or modified sequence from Homo sapiens__NP_004355.2__HsCEBPA (opt8)
gggagagucccgcagucggcguccagcggcucugcuuguucgugugugugucguugcaggccuuauucaagcuuaccauggaauccgccgacuucuacgaagccgaaccacgaccccccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1315 - RNA, 1382 nt, Artificial Sequence
  mRNA product Design3 comprising derived and/or modified sequence from Homo sapiens__NP_004355.2__HsCEBPA(15-358) (opt8)
gggagagucccgcagucggcguccagcggcucugcuuguucgugugugugucguugcaggccuuauucaagcuuaccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1316 - RNA, 1772 nt, Artificial Sequence
  mRNA product Design3 comprising derived and/or modified sequence from Homo sapiens__NP_000448.3__HsHNF4A (opt8)
gggagagucccgcagucggcguccagcggcucugcuuguucgugugugugucguugcaggccuuauucaagcuuaccaugcgccuauccaaaacacucguagacauggauauggcagacuacuccgccgcccucgaccccgccuacacaacucuagaguucgaaaacguccaaguccucaccaugggcaacgauaccuccccauccgaaggaaccaaccucaacgccccaaacucccucggcgucucagcccuaugcgccaucugcggagaccgcgccaccgggaaacacuacggcgccucguccugugacgggugcaaagguuucuuccgccgcuccguccgcaaaaaucacauguacuccugccgauucucccgacaaugcgucguagacaaagauaaaagaaaccagugccgcuacugccgccugaagaaaugcuuccgcgcaggaaugaagaaagaagccguccaaaacgaacgcgaccgcaucucaacccgacgcuccucauaugaagacuccagccuccccucaaucaacgcacuacuacaagccgaaguccucagccgccaaauaacaucaccugucucuggcaucaacggagacaucagagcaaagaaaauugcaucaaucgcagacgucugcgaaucuaugaaagaacaacuccucguccugguugaaugggccaaauacaucccagccuucugcgaacucccccucgacgaccaagucgcacuacuccgcgcacacgccggcgaacaccuccuacucggcgccacaaaacgcuccauggucuucaaagacguccuccuccuaggcaacgacuacaucguccccagacacugccccgaacucgccgaaaugagccgagucucaauccggauacuagacgaacucguacucccauuccaagagcuucaaauagacgacaaugaauacgccuaccuuaaagcaauaauauucuucgauccagacgcuaaaggacucucugaccccggcaaaaucaaacgcuuacgaucccaaguccaagucucacuagaagacuacaucaacgaccgacaauacgacucccgcggcagauucggggaacuccuccuccuccuacccacacuccaaagcaucaccuggcaaaugaucgaacaaauccaauucauaaaacucuucggaauggccaaaaucgacaaccuccuacaagaaaugcuacucggcggcucccccuccgacgcaccccacgcccaucacccccuccacccacaccucaugcaagaacacaugggcaccaacguaauagucgccaacaccaugccaacccaccuaucaaacggucaaaugugcgaauggccuagaccccguggccaagccgccacgcccgaaacaccacagcccuccccacccggcggcuccggcucagaacccuacaaacuacuacccggagccgucgccacaaucguaaaaccccuaucggccaucccccaacccaccaucaccaaacaagaagucaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1317 - RNA, 977 nt, Artificial Sequence
  mRNA product Design3 comprising derived and/or modified sequence from Homo sapiens__NP_061986.1__HsFGF21 (opt8)
gggagagucccgcagucggcguccagcggcucugcuuguucgugugugugucguugcaggccuuauucaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1318 - RNA, 1703 nt, Artificial Sequence
  mRNA product Design3 comprising derived and/or modified sequence from Homo sapiens__NP_078852.3__HsOGFRL1 (opt8)
gggagagucccgcagucggcguccagcggcucugcuuguucgugugugugucguugcaggccuuauucaagcuuaccaugggcaaccuacucggcggcgucucguuccgcgaaccaaccaccguagaggacugcgacagcaccuggcaaaccgacuccgaaccugaacccgaagaacccggccccggcggcggcagcgaaggccccggccaagaaucggaacaacccgcccaacccccagaacaagccggcggacgacccggcgccucacccgccccagacgaagacgcagaagccgccggggccgagcaaggcggcgacucuaccgaagccacagcuaaaccaaaacggagcuucuacgccgcccgcgaccucuacaaauaccgccaccaauaccccaacuucaaagacauccgcuaccaaaacgaccuauccaaucuucgcuuuuauaaaaacaaaauaccuuucaaacccgacggcgucuacaucgaagaaguucuaagcaaauggaaaggcgacuacgaaaaacucgaacacaaccacaccuacauccaauggcuauucccgcuacgcgaacaaggccugaacuucuaugccaaagaacuaaccaccuacgaaauagaagaguucaaaaaaaccaaagaagcaauacgccgcuuccuccuagccuacaaaaugaugcucgaauuuuucgggaucaaacuaaccgacaaaaccggcaacgucgcccgcgcuguaaauuggcaagaacgauuccaacaccuaaacgagucccagcacaacuaccuaagaaucacccgaauacucaaaucccucggagagcucggcuacgaauccuucaaauccccacucgucaaguucauccuccacgaggcccucgucgagaacaccauccccaacaucaaacaguccgcacuagaauacuucguguacaccauccgcgaccgccgugaacgacgcaaacuccuacgcuucgcccaaaaacacuacacacccuccgaaaacuucaucuggggcccacccagaaaagaacaauccgaaggauccaaagcccaaaaaauguccagcccacuagccagcucccauaacucacaaacaucaaugcacaaaaaggccaaagacucaaaaaacuccuccagcgccguacaccucaacuccaaaaccgccgaagacaaaaaagucgcccccaaggaacccgucgaagaaacagaccgcccaucgccagaacccucaaacgaagccgcaaaaccccgcaacaccgagaaagacucaaaugccgaaaauaugaacucgcaacccgagaaaacagucaccacccccacagaaaaaaaagaauccgugagcccagaaaacaacgaagaaggcggcaacgacaaccaagacaacgaaaacccuggaaacaccaacugccacgacgucguacucguacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1319 - RNA, 905 nt, Artificial Sequence
  mRNA product Design3 comprising derived and/or modified sequence from Homo sapiens__NP_008842.1__HsRLN1 (opt8)
gggagagucccgcagucggcguccagcggcucugcuuguucgugugugugucguugcaggccuuauucaagcuuaccaugccccgccucuuccucuuccaccuccuagaauuuugccuccuccucaaccaauucucccgcgccgucgccgccaaauggaaagacgacguuauaaaacucugcggccgcgaacucguccgcgcccaaaucgccaucugcggcaugucaaccugguccaaacgcucacucucacaagaagacgccccccaaaccccccgcccagucgccgaaaucgucccaucauucaucaacaaagacacagaaaccauaaucaucaugcucgaauuuauagccaaccucccccccgaacucaaagccgcccucuccgaacgacaacccucccuccccgaacuacaacaauacgucccagcccucaaagacucaaaccucucauuugaagaauuuaaaaaacuaauccgcaaccgacaauccgaagccgccgacuccaaccccuccgaacuaaaauaccucggccuugacacccacagccaaaaaaaacgcagacccuacgucgcacucuucgaaaaaugcugccucaucggaugcaccaaacgcucccucgccaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1320 - RNA, 905 nt, Artificial Sequence
  mRNA product Design3 comprising derived and/or modified sequence from Homo sapiens__NP_604390.1__HsRLN2 (opt8)
gggagagucccgcagucggcguccagcggcucugcuuguucgugugugugucguugcaggccuuauucaagcuuaccaugccccgccucuucuucuuccaccuccucggcguaugccuccuccucaaccaauucucccgcgccgucgccgacuccuggauggaagaagucaucaaacucugcggacgcgaacucguccgcgcccaaaucgccauaugcggcauguccacuugguccaaacgcucccucucccaagaggacgcaccacaaaccccccgacccgucgcagaaaucgucccauccuucaucaacaaagacaccgaaacuaucaacaugaugucagaauuugucgcaaaccucccccaagaacuuaaacucacccucuccgaaaugcaacccgcccucccccaacuacaacaacacguccccguacuaaaagacuccucccuccucuuugaagaauuuaaaaaacuaauccgcaaccgccaaucagaagccgccgacagcucccccucagaacucaaauaccucggacucgacacacacucccgcaaaaaacgccaacuauacucagcacucgccaacaaaugcugccacgucggcugcaccaaacgcucacucgcccgauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1321 - RNA, 776 nt, Artificial Sequence
  mRNA product Design3 comprising derived and/or modified sequence from Homo sapiens__NP_543140.1__HsRLN3  (opt8)
gggagagucccgcagucggcguccagcggcucugcuuguucgugugugugucguugcaggccuuauucaagcuuaccauggcgagauauauguugcuacugcucuuggccgugugggugcucacgggagagcucuggcccggggccgaggccagggccgcgcccuauggagugcgauugugcgggcgcgaguucauacgcgcgguaauauucacgugcgggggaucgcgcuggcgcaggagcgauaucuuggcccaugaagcgaugggggacacauucccggacgcagacgcggacgaggacucgcucgcgggcgagcucgaugaagcgauggggaguucggaauggcuagcgcuaacgaaaucgccccaggccuuuuacaggggcaggccaucauggcagggaacgcccgggguccugcgagggagcagggacguguuagcgggcuugagcucaagcuguugcaagugggggugcucgaaaucagaaauaagcucgcucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1322 - RNA, 1757 nt, Artificial Sequence
  mRNA product Design3 comprising derived and/or modified sequence from Homo sapiens__NP_002412.1__HsMMP1 (opt8)
gggagagucccgcagucggcguccagcggcucugcuuguucgugugugugucguugcaggccuuauucaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1323 - RNA, 1517 nt, Artificial Sequence
  mRNA product Design3 comprising derived and/or modified sequence from Homo sapiens__NP_002412.1__HsMMP1(1-19,100-469) (opt8)
gggagagucccgcagucggcguccagcggcucugcuuguucgugugugugucguugcaggccuuauucaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1324 - RNA, 3704 nt, Artificial Sequence
  mRNA product Design3 comprising derived and/or modified sequence from Clostridium histolyticum__BAA77453.1__ColG (opt8)
gggagagucccgcagucggcguccagcggcucugcuuguucgugugugugucguugcaggccuuauucaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1325 - RNA, 3428 nt, Artificial Sequence
  mRNA product Design3 comprising derived and/or modified sequence from Clostridium histolyticum__BAA77453.1__HsALB(1-18)_ColG(111-1118) (opt8)
gggagagucccgcagucggcguccagcggcucugcuuguucgugugugugucguugcaggccuuauucaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1326 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt8)
gggagagucccgcagucggcguccagcggcucugcuuguucgugugugugucguugcaggccuuauucaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1327 - RNA, 3452 nt, Artificial Sequence
  mRNA product Design3 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1328 - RNA, 3413 nt, Artificial Sequence
  mRNA product Design3 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1329 - RNA, 3347 nt, Artificial Sequence
  mRNA product Design3 comprising derived and/or modified sequence from Clostridium histolyticum__BAA34542.1__HsALB(1-18)_ColH(41-1021) (opt8)
gggagagucccgcagucggcguccagcggcucugcuuguucgugugugugucguugcaggccuuauucaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1330 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt8)
gggagagucccgcagucggcguccagcggcucugcuuguucgugugugugucguugcaggccuuauucaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1331 - RNA, 1193 nt, Artificial Sequence
  mRNA product Design3 comprising derived and/or modified sequence from Homo sapiens__NP_003801.1__HsTNFSF10 (opt9)
gggagagucccgcagucggcguccagcggcucugcuuguucgugugugugucguugcaggccuuauucaagcuuaccauggccaugauggaaguccaaggcggaccaucccucggccaaaccugcguccuaaucgucaucuucaccguccuccuccaaucacucugcguagccgucaccuacguauacuucacaaacgaacuaaaacaaaugcaggacaaauacuccaaauccggcaucgccugcuuccucaaagaagacgacuccuacugggacccaaacgacgaagaauccaugaacuccccaugcuggcaagucaaauggcaacuccgccaacucguccgcaaaaugauccuccgcaccagcgaagaaaccaucagcacaguacaagaaaaacaacaaaacaucagcccccucguacgcgagagaggaccccaacgcguagcagcccacaucacaggcaccagaggccgcuccaacacccucuccucccccaacuccaaaaacgaaaaagcccucggccgcaaaaucaacuccugggaaagcucccgcucaggccacucauucuuauccaaccuacaccuccgcaacggagaacucguaauccacgaaaaaggcuucuacuacaucuacucccaaaccuacuuccgcuuccaagaagaaaucaaagaaaacacuaaaaacgacaaacagaugguccaauacaucuacaaauacaccuccuaccccgaccccauacuccucaugaaaagcgccagaaacuccugcuggagcaaagacgccgaauacggccuauacuccaucuaccaaggcggcaucuucgaacucaaagaaaacgaccgaaucuucgucuccguaaccaacgaacaccuaaucgacauggaccacgaagccuccuucuucggagcuuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1332 - RNA, 914 nt, Artificial Sequence
  mRNA product Design3 comprising derived and/or modified sequence from Homo sapiens__NP_003801.1__HsTNFSF10(95-281) (opt9)
gggagagucccgcagucggcguccagcggcucugcuuguucgugugugugucguugcaggccuuauucaagcuuaccaugaccucagaagaaaccaucuccacaguccaagaaaaacaacaaaacauaagcccccucguccgcgaacgcggaccccaacgcguagccgcacacaucaccggaacccgcggccgauccaacacccucuccucacccaacuccaaaaacgaaaaagcccucggccgcaaaaucaacuccugggaaucaucccgcuccggccacuccuuccuaucaaaccuccaccuacgaaacggcgaacucgucauccacgaaaaaggcuucuacuacaucuacucccaaacauacuuccgauuccaagaagaaaucaaagaaaacaccaaaaacgacaaacaaaugguccaauacaucuacaaauacacauccuaccccgacccaauacuacucaugaaaagcgcccgcaacuccugcuggucaaaagacgccgaauacggacucuacuccaucuaccaaggcggcaucuucgaacugaaagaaaacgaccgcauauucguauccgucaccaacgaacaccucaucgacauggaccacgaagccagcuucuucggcgccuuucucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1333 - RNA, 965 nt, Artificial Sequence
  mRNA product Design3 comprising derived and/or modified sequence from Homo sapiens__NP_003801.1__HsALB(1-18)_HsTNFSF10(95-281) (opt9)
gggagagucccgcagucggcguccagcggcucugcuuguucgugugugugucguugcaggccuuauucaagcuuaccaugaaauggguaacauucaucucccuccuauuccuauucuccuccgccuacuccaccuccgaagaaaccauauccacaguccaagaaaaacaacaaaacauaucaccccucguacgagaacgaggcccccaacgcgucgccgcacacaucaccggcacccgcggccgcuccaacacccucuccucacccaacuccaaaaacgaaaaagcccucggccgcaaaaucaacuccugggaauccucacgauccggccacuccuuccucucaaaccuccaccuccgcaacggcgaacucgucauccacgaaaaaggcuucuacuacaucuacucacaaacauacuuucgcuuccaagaagaaaucaaagaaaacaccaaaaacgacaaacaaaugguccaauacaucuacaaauacaccucuuaccccgacccaauccuccucaugaaaucagcccgcaacuccugcugguccaaagacgccgaauacggccucuacuccauauaccaaggcggcauauucgaacuaaaagaaaacgaccgaauauucgucuccguaaccaacgaacaccucaucgacauggaccacgaagccucauucuucggagccuuucucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1334 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt9)
gggagagucccgcagucggcguccagcggcucugcuuguucgugugugugucguugcaggccuuauucaagcuuaccaugaaauggguaaccuucaucucccuccucuuccucuuuuccuccgccuacucccgcaugaaacaaauagaagacaaaaucgaagaaauccucuccaaaaucuaccacaucgaaaacgaaauagcacgaaucaagaaacuaauaggagaaaccuccgaagaaaccauauccaccguccaggaaaaacaacaaaacauaagcccccucguccgcgaacgcggaccccaacgcgucgccgcccacaucaccgggacccgaggccgauccaacacccugagcucacccaacagcaaaaacgaaaaagcacuaggccgcaaaaucaacuccugggaauccuccagauccggccacuccuuccuaagcaaccuccaccucagaaacggcgaacucguaauccacgaaaaaggcuucuacuacaucuacucacaaaccuacuuccgcuuccaagaagaaaucaaagaaaacaccaaaaacgacaaacaaaugguccaauacaucuacaaauacacaagcuaccccgacccaauccuccuaaugaaaagcgcccgcaacuccugcuggucaaaagacgccgaauacggacucuacuccauauaccaaggcggcaucuucgaacucaaagaaaacgaccgcaucuucgucuccgucacaaacgaacaccucauagacauggaccacgaagccuccuucuucggagccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1335 - RNA, 1424 nt, Artificial Sequence
  mRNA product Design3 comprising derived and/or modified sequence from Rattus norvegicus__NP_036656.1__RnCebpa (opt9)
gggagagucccgcagucggcguccagcggcucugcuuguucgugugugugucguugcaggccuuauucaagcuuaccauggaauccgccgacuucuacgaagccgaaccccgacccccaaugucaagucaucuccaaagcccaccccacgcacccuccaacgccgccuucggauuccccagaggcgccggacccgcacccccaccagcaccacccgcagcacccgaaccccuaggagguaucugcgaacacgaaaccucaauagacaucuccgcauacauagacccagcagccuucaacgacgaguuccuagccgaccuauuccaacacagccgacaacaagaaaaagccaaagccgcagcaggacccgcaggaggaggcggagacuucgacuacccaggcgcaccagccggaccaggaggagcaguaauguccgccggagcccacggcccaccacccggcuacgggugcgcagccgcgggcuaucuugacggccgccucgaaccccucuacgaacgaguaggcgcacccgcccucagaccccucgucauaaaacaagaaccccgugaagaagacgaagcaaaacaacucgcccucgcaggccuauuccccuaccaacccccaccuccaccacccccaccccacccccacgcaagccccgcacaccuugcagcgccccaccuccaauuccaaauagcccacugcggacaaaccaccaugcaccuccaaccaggccaccccacaccaccacccaccccaguucccucaccccaccccgccccagccaugggagccgcaggccuacccggacccggaggaucccucaaaggccuagccggcccccacccagaucuccgaacaggaggcggaggaggaggcggagccggagcaggcaaagcgaagaaauccgucgacaaaaauuccaacgaauaccgagucagacgcgaacgcaacaacauagccguccgaaaaucccgagacaaagccaaacaaagaaacguagaaacacaacaaaaaguccucgaacuaacaagcgacaacgaccgccuacgcaaacgcgucgaacaacucucccgagaacuagacacccuacgcggaaucuuucgccaacuccccgaaucaagccuaguaaaagcuaugggcaacugcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1336 - RNA, 1382 nt, Artificial Sequence
  mRNA product Design3 comprising derived and/or modified sequence from Rattus norvegicus__NP_036656.1__RnCebpa(15-344) (opt9)
gggagagucccgcagucggcguccagcggcucugcuuguucgugugugugucguugcaggccuuauucaagcuuaccaugucaucccaucuccaaucacccccccacgccccauccaacgccgccuucggcuucccgcggggcgcuggacccgcaccaccccccgcaccccccgccgcacccgaaccccucggcggcaucugcgaacacgaaaccucaauagacaucuccgcauacauagacccagcugccuucaacgaugaauuccuagccgaccucuuccaacacucccgccaacaagaaaaagcaaaagcagcagccggacccgcaggcggaggaggagacuucgacuacccaggagcuccagcaggacccggcggagcagucauguccgcaggcgcacacggacccccacccggcuacggaugcgcagccgcaggcuaccucgacggccgccucgaaccccuauacgaacgcguaggagccccagcccucagaccacucgucauaaaacaagaaccccgagaagaagacgaagccaaacaacuagcccucgccggccucuucccauaccaaccaccaccucccccaccccccccacacccccacgccucaccagcccaccuagccgcaccacaccuacaauuccaaauagcccacugcggucaaacuaccaugcaccuacaacccggccacccaacaccaccaccaacacccgucccauccccccaucccgcacccgcaaugggagccgccggccuacccggccccggaggcucacucaaaggccuagccggcccccaccccgaccuaagaaccggaggcggaggcggcggcggagccggcgccggaaaagcaaaaaaguccguagacaaaaacucaaacgaauaccgagucagacgagaacgcaacaacauagccguccgcaaaucaagagacaaggcaaaacaaagaaacguugaaacccaacagaaaguacucgaacuaaccagcgacaacgaccgccuccgcaaacgcguagaacaauuaucccgugaacuagacacccuccgaggcauauuccgccaacucccagaaucgucccuagucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1337 - RNA, 1427 nt, Artificial Sequence
  mRNA product Design3 comprising derived and/or modified sequence from Mus musculus__NP_031704.2 __MmCebpa (opt9)
gggagagucccgcagucggcguccagcggcucugcuuguucgugugugugucguugcaggccuuauucaagcuuaccauggaauccgccgacuucuacgaaguagaaccccgcccacccauguccucucaccuccaaucccccccccacgcaccauccaacgcagccuucggcuucccacgaggcgccggacccgcacccccccccgcacccccagcagcccccgaaccccuuggcggaaucugcgaacacgaaaccucaaucgacauuucagccuacauagaccccgccgcauucaacgacgaguuccuagccgaccucuuccaacacucccgccaacaagaaaaagcaaaagcagcagcaggaccagcaggcggcggaggcgauuucgacuaccccggcgcacccgcaggcccaggcggcgcagucauguccgccggugcccacggcccaccacccggcuacggcugcgccgccgccggcuaccucgacggcagacuagaaccccucuacgaacgugucggcgcccccgcccuacgaccacucgucaucaaacaagaaccucgcgaagaagacgaagcuaaacaacuagcccucgccggccuauucccauaccaacccccccccccgccaccccccccacacccacacgccucccccgcccaccucgcagcaccccaccuccaauuccaaauagcacacugcggccaaaccaccaugcacuuacaacccggacaccccaccccaccccccaccccagucccauccccccacgccgccccagcccucggcgcagccggccuccccggacccggcagcgcucucaaaggccucgccggcgcccaccccgaccuccgcaccggcggcggcgguggcggcucaggugccggcgcgggcaaagccaaaaaaagcguagacaaaaacucaaacgaauaccgcguccgacgcgaacgaaacaacaucgccguucgcaaaagccgagacaaagccaaacaacgcaacgucgaaacccaacaaaaaguacuagaacucacaucagacaacgaccgucuacgaaaacgagucgaacaacuaucacgagaacucgacacacuacgcggaaucuuccgacaacuucccgaaucaucccucguaaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1338 - RNA, 1385 nt, Artificial Sequence
  mRNA product Design3 comprising derived and/or modified sequence from Mus musculus__NP_031704.2 __MmCebpa(15-359) (opt9)
gggagagucccgcagucggcguccagcggcucugcuuguucgugugugugucguugcaggccuuauucaagcuuaccauguccagccacuuacaaucacccccccacgcccccuccaacgccgcauucggcuuccccagaggcgccggcccagcacccccuccagcccccccagccgccccagaaccccuuggcggcaucugcgagcacgaaaccucuauagacaucucggcauacaucgaccccgccgccuucaacgacgaauucuuagccgaccuauuccaacacucccgccaacaagaaaaagccaaagccgcagccggacccgccggcggcggaggcgacuucgacuaccccggagcacccgccggccccgggggcgcaguaaugucagccggcgcacacggcccccccccaggcuacggaugcgccgccgccggauaccuagacggccgacucgaaccccucuaugaacgugucggcgcccccgcccuccgaccccuagucaucaaacaagaaccccgcgaagaagacgaagcaaaacaacucgcccucgccggccucuucccauaccaacccccaccccccccaccccccccccacccacacgccucucccgcccaccuagcagcuccccaccuccaauuccaaauagcucacugcggacaaaccacgaugcaccuacaacccggacaccccacuccacccccaacacccguaccuuccccacacgcagcacccgcccucggcgcagcaggccuacccggccccggaucagcccucaaaggccucgcaggcgcccacccagaccuacgaaccggaggcggcggcggcggcuccggagcuggcgccggcaaagccaaaaaaucaguagacaaaaacuccaacgaauaccgaguccgcagagaacgaaacaacaucgcaguccgcaaaucccgcgacaaagccaaacaacgaaacguugaaacacaacaaaaaguacuagaacucaccuccgauaacgaccgacuaagaaaacgagucgaacaacucucccgcgaacucgacacccuaagaggcaucuuccgacaacuccccgaauccucccucgucaaagcaaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1339 - RNA, 1424 nt, Artificial Sequence
  mRNA product Design3 comprising derived and/or modified sequence from Homo sapiens__NP_004355.2__HsCEBPA (opt9)
gggagagucccgcagucggcguccagcggcucugcuuguucgugugugugucguugcaggccuuauucaagcuuaccauggaauccgcagacuucuacgaagccgaaccccgaccccccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1340 - RNA, 1382 nt, Artificial Sequence
  mRNA product Design3 comprising derived and/or modified sequence from Homo sapiens__NP_004355.2__HsCEBPA(15-358) (opt9)
gggagagucccgcagucggcguccagcggcucugcuuguucgugugugugucguugcaggccuuauucaagcuuaccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1341 - RNA, 1772 nt, Artificial Sequence
  mRNA product Design3 comprising derived and/or modified sequence from Homo sapiens__NP_000448.3__HsHNF4A (opt9)
gggagagucccgcagucggcguccagcggcucugcuuguucgugugugugucguugcaggccuuauucaagcuuaccaugcgccuaagcaaaacccuugucgacauggacauggcagacuacucagccgcacucgaccccgcauacacaacacucgaauuugaaaacguacaaguccuaacaaugggcaacgacacaucaccaagcgaagguaccaaucuaaacgcccccaacagccugggcgucucagcucuuugcgcaaucugcggcgaccgcgcaaccgguaaacacuacggcgccuccuccugcgacggcugcaaaggauucuuccgccguuccguucgcaaaaaccacauguacuccugccgauuuagccgacaaugcgucgucgacaaagacaaaagaaaccaaugccgcuauugccgccucaaaaaaugcuuccgcgccggaaugaaaaaagaagcaguccaaaacgaacgcgaccgcaucagcacacgacgaucguccuacgaagacuccucacuacccucaaucaaugcacuccuccaagccgagguccuaucccgacaaaucaccucacccgucuccggcauaaacggcgacauucgcgccaaaaaaaucgccuccaucgccgacgucugcgaguccaugaaagagcaacuccucguccucgucgaaugggccaaauacauccccgcauucugugaacucccccucgacgaccaagucgcccuacuucgcgcccacgccggcgaacaucuccuccuaggcgccaccaagcgguccaugguauucaaagacguccuacuccucggcaacgacuacaucgucccccgacauugcccagaacucgccgaaaugucacgagucuccauccgaauacuugacgaacucguccuacccuuccaagaacuccaaaucgacgacaacgaguacgccuaccuaaaagcaaucaucuucuucgaccccgacgccaaaggacugucagacccaggcaaaaucaaacgccuacgcucccagguucaagucucccuagaagacuauaucaacgaccgccaguacgacuccagaggccgauucggagaacuccuccuacuccuaccgacccuacaauccaucaccuggcaaaugaucgaacagauccaauucaucaaacuauucggaauggccaaaaucgacaaccuacuccaagaaaugcuucucggaggcuccccauccgacgccccccacgcccaccacccucuccacccccaccucaugcaggaacacaugggcaccaacgucaucgucgcaaacacuaugccuacccaccucuccaacggacaaaugugcgaauggccacgcccacgcggccaagccgccacacccgaaaccccacaaccauccccccccggcggaagcggcagcgaaccuuacaaacuccuacccggcgccgucgccacuauagucaaaccucucuccgccaucccacagcccaccaucaccaagcaagaagucaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1342 - RNA, 977 nt, Artificial Sequence
  mRNA product Design3 comprising derived and/or modified sequence from Homo sapiens__NP_061986.1__HsFGF21 (opt9)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1343 - RNA, 1703 nt, Artificial Sequence
  mRNA product Design3 comprising derived and/or modified sequence from Homo sapiens__NP_078852.3__HsOGFRL1 (opt9)
gggagagucccgcagucggcguccagcggcucugcuuguucgugugugugucguugcaggccuuauucaagcuuaccaugggcaaccuacuaggcggagucucauuccgcgaaccaaccaccguagaagacugcgacucaaccuggcaaaccgacuccgaaccagaaccggaggaacccggccccggcggagguagcgagggcccaggccaagaaagcgaacaaccagcccaaccacccgagcaagcaggaggacgccccggcgcaagccccgcacccgacgaagacgccgaagccgccggugccgaacaaggcggagacagcacagaagcaaccgcuaaacccaaacgcagcuucuacgcggcacgagaccuauacaaauaccggcaccaguacccaaacuucaaagacauccgauaccaaaacgaccucuccaaccucagauucuacaaaaacaagauccccuuuaaacccgacggagucuacaucgaagaaguauugagcaaauggaaaggcgacuacgaaaaacucgaacacaaccacacauacauacaauggcuauucccccuaagagaacaaggccugaacuucuacgcaaaagaacuaacaacauacgaaaucgaagaguucaaaaagacaaaagaagcaauccgcagauucuuacucgccuacaaaaugaugcuagaguucuucggcaucaaacuaacagacaaaacaggcaacgucgcccgagccgucaacuggcaggaacgcuuccaacaccucaacgaaucacaacacaacuaucuccggaucacccgaaucuuaaaaucacucggagaacuaggcuacgaaucguucaaaucaccccuaguuaaauucauccuccacgaagcccucguagaaaacaccauccccaacaucaaacaaagcgcgcuagaauacuucgucuacacaauccgcgaccgcagagaacgccgaaaacuacuccgcuucgcucagaaacacuacaccccaagcgaaaacuucaucuggggaccaccccgaaaagaacaauccgagggcuccaaagcccaaaagauguccagcccccucgcaucaucgcacaacagccaaaccucaaugcacaagaaagccaaagacuccaaaaacagcucaagcgccguccaccucaacagcaaaaccgcagaagacaagaaagucgccccaaaagaacccgucgaagagaccgaccgccccucacccgaacccagcaacgaagccgcaaaaccccgcaacaccgaaaaagacagcaacgccgaaaacaugaacucccaacccgagaaaaccguaacaacacccaccgaaaagaaagaaagcguauccccugaaaacaacgaagaaggaggaaacgacaaccaagacaacgaaaacccaggcaacacgaacugccacgacguaguccuaguacaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1344 - RNA, 905 nt, Artificial Sequence
  mRNA product Design3 comprising derived and/or modified sequence from Homo sapiens__NP_008842.1__HsRLN1 (opt9)
gggagagucccgcagucggcguccagcggcucugcuuguucgugugugugucguugcaggccuuauucaagcuuaccaugccccgccuauuccucuuccaccuccuagaauuuugccuccuccucaaccaauucucccgcgccgucgccgccaaauggaaagacgacgucaucaaacucugcggccgcgaacucguacgcgcccaaaucgccauaugcggcauguccaccuggucaaaacgcucccucucccaagaagacgccccccaaacaccccgaccagucgcagaaaucguccccuccuucaucaacaaagacacagaaaccaucaucaucaugcucgaauuuaucgcaaaccucccccccgaacucaaagccgcccucuccgaacgccaacccucacuccccgaacuccaacaauacguccccgcccucaaagacuccaaccuuuccuucgaagaauuuaaaaaacuaauccgaaaccgucaaucagaagccgccgacuccaaccccuccgaacucaaauaccuaggccuagacacccacucccaaaaaaaacgacgacccuacgucgcccucuucgaaaaaugcugccucaucggcugcacaaaacgcucccucgcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1345 - RNA, 905 nt, Artificial Sequence
  mRNA product Design3 comprising derived and/or modified sequence from Homo sapiens__NP_604390.1__HsRLN2 (opt9)
gggagagucccgcagucggcguccagcggcucugcuuguucgugugugugucguugcaggccuuauucaagcuuaccaugccccgccucuucuucuuccaccuccucggcgucugccuccuccuuaaccaguucucccgcgccguagccgacuccuggauggaagaagucaucaaacucugcggccgcgaacucguccgcgcacaaaucgccaucugcggaaugucaaccugguccaaacgcucacucucccaagaagacgccccccaaaccccccgcccugucgcagaaaucguccccuccuucaucaacaaagacaccgaaaccaucaacaugauguccgaauuugucgccaaccucccccaagaacucaaacucacccuaucagaaaugcaacccgcccuaccccaacuccaacagcacguacccguccucaaagacuccagccuccuauucgaagaauuuaaaaaacucauccgaaaccgacaauccgaagccgcagacucaucacccuccgaacuaaaauaucucggccucgacacccacucccgcaaaaaacgccaacucuacuccgcccucgccaacaaaugcugccacgucggcugcaccaaacgcucacucgcccgcuucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1346 - RNA, 776 nt, Artificial Sequence
  mRNA product Design3 comprising derived and/or modified sequence from Homo sapiens__NP_543140.1__HsRLN3  (opt9)
gggagagucccgcagucggcguccagcggcucugcuuguucgugugugugucguugcaggccuuauucaagcuuaccauggcgcgcuacaugcugcuauugcuccuggccgugugggugcucacgggcgagcucuggcccggggcagaggcaagggcagcgcccuauggagugcgauugugcgggcgagaguucauacgcgcggucauauucacgugcgggggaucacgauggcgcaggagcgauaucuuggcccaugaagcgaugggggacacguucccggacgcggacgcggacgaggacucgcuagcgggcgaacucgaugaagcgauggggagcucggaauggcucgcgcucacgaaaucgccacaggccuuuuacaggggcaggcccucguggcagggcacgcccggggucuugcgcgggaguagggacgugcucgcgggauugagcucgagcuguugcaagugggggugcucgaaaucggaaauaagcucgcuauguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1347 - RNA, 1757 nt, Artificial Sequence
  mRNA product Design3 comprising derived and/or modified sequence from Homo sapiens__NP_002412.1__HsMMP1 (opt9)
gggagagucccgcagucggcguccagcggcucugcuuguucgugugugugucguugcaggccuuauucaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1348 - RNA, 1517 nt, Artificial Sequence
  mRNA product Design3 comprising derived and/or modified sequence from Homo sapiens__NP_002412.1__HsMMP1(1-19,100-469) (opt9)
gggagagucccgcagucggcguccagcggcucugcuuguucgugugugugucguugcaggccuuauucaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1349 - RNA, 3704 nt, Artificial Sequence
  mRNA product Design3 comprising derived and/or modified sequence from Clostridium histolyticum__BAA77453.1__ColG (opt9)
gggagagucccgcagucggcguccagcggcucugcuuguucgugugugugucguugcaggccuuauucaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1350 - RNA, 3428 nt, Artificial Sequence
  mRNA product Design3 comprising derived and/or modified sequence from Clostridium histolyticum__BAA77453.1__HsALB(1-18)_ColG(111-1118) (opt9)
gggagagucccgcagucggcguccagcggcucugcuuguucgugugugugucguugcaggccuuauucaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1351 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt9)
gggagagucccgcagucggcguccagcggcucugcuuguucgugugugugucguugcaggccuuauucaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1352 - RNA, 3452 nt, Artificial Sequence
  mRNA product Design3 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1353 - RNA, 3413 nt, Artificial Sequence
  mRNA product Design3 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1354 - RNA, 3347 nt, Artificial Sequence
  mRNA product Design3 comprising derived and/or modified sequence from Clostridium histolyticum__BAA34542.1__HsALB(1-18)_ColH(41-1021) (opt9)
gggagagucccgcagucggcguccagcggcucugcuuguucgugugugugucguugcaggccuuauucaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1355 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt9)
gggagagucccgcagucggcguccagcggcucugcuuguucgugugugugucguugcaggccuuauucaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1356 - RNA, 1193 nt, Artificial Sequence
  mRNA product Design3 comprising derived and/or modified sequence from Homo sapiens__NP_003801.1__HsTNFSF10 (opt11)
gggagagucccgcagucggcguccagcggcucugcuuguucgugugugugucguugcaggccuuauucaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1357 - RNA, 914 nt, Artificial Sequence
  mRNA product Design3 comprising derived and/or modified sequence from Homo sapiens__NP_003801.1__HsTNFSF10(95-281) (opt11)
gggagagucccgcagucggcguccagcggcucugcuuguucgugugugugucguugcaggccuuauucaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1358 - RNA, 965 nt, Artificial Sequence
  mRNA product Design3 comprising derived and/or modified sequence from Homo sapiens__NP_003801.1__HsALB(1-18)_HsTNFSF10(95-281) (opt11)
gggagagucccgcagucggcguccagcggcucugcuuguucgugugugugucguugcaggccuuauucaagcuuaccaugaaaugggucaccuucaucucccuccuauuccucuucuccuccgccuacuccaccuccgaagaaaccaucuccaccguccaagaaaaacaacaaaacaucucaccccuuguccgcgaacgcggcccccaacgcguagccgcccacaucaccggcacccgcggccgcuccaacacccucuccucccccaacuccaaaaacgaaaaagcccucggccgcaaaaucaacuccugggaauccucccgcuccggccacucauuccucuccaaccuccaccuccgaaacggcgaacucgucauccaugaaaaaggcuucuacuacaucuacucccaaaccuacuuccgcuuccaagaagaaaucaaagaaaacaccaaaaacgacaaacaaaugguccaauacaucuacaaauacaccuccuaccccgacccaauccuacuaaugaaauccgcccgcaacuccugcugguccaaagacgccgaauacggacucuacuccauauaccaaggcggcaucuucgaacucaaagaaaacgaccgcaucuucgucuccgucaccaacgaacaccucaucgacauggaccacgaagccuccuucuucggcgccuuccucgucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1359 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt11)
gggagagucccgcagucggcguccagcggcucugcuuguucgugugugugucguugcaggccuuauucaagcuuaccaugaagugggugaccuucaucucgcuccuguuccuguucucaagcgcguacucgcgcaugaaacaaaucgaagacaagaucgaggaaauacucucaaaaauauaccacaucgagaacgagaucgcgcgcauaaagaagcuaauaggcgagaccucggaagagaccauaagcacaguccaggaaaagcaacagaacauaagcccgcucgugcgcgagcgcggaccccagcgcguggccgcgcacauaaccgggacccggggccgcaguaacacccugagcucgcccaacagcaagaacgagaaagcacuagggcgaaaaaucaauagcugggaaucgagcagaagcgggcacucauuccuauccaaccuccaccucaggaacggggaacuggucauacacgagaaaggguucuacuacauauacucccaaacauacuuccgauuccaagaagaaauaaaagagaacacgaaaaacgacaagcaaaugguccaguacauauacaaauacacaagcuaccccgaccccauacucuugaugaaaagcgcacgcaacagcugcuggucgaaagacgccgaguacgggcucuacagcauauaccagggcggaaucuucgaacugaaagagaacgaccgcaucuucgugagcguaaccaacgaacaccucauagacauggaccacgaagcgagcuucuucggggccuuccuagugggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1360 - RNA, 1424 nt, Artificial Sequence
  mRNA product Design3 comprising derived and/or modified sequence from Rattus norvegicus__NP_036656.1__RnCebpa (opt11)
gggagagucccgcagucggcguccagcggcucugcuuguucgugugugugucguugcaggccuuauucaagcuuaccauggaauccgcagacuucuacgaagccgaaccccgcccacccaugucaucccaccuccaaucaccaccccacgcacccucuaaugccgccuucggauucccccgcggcgccggacccgcacccccacccgcaccacccgccgcccccgaaccccucggaggaaucugcgaacacgaaaccagcaucgacaucucagccuacaucgaccccgccgcauucaacgacgaguuccucgccgaccuuuuccaacacuccagacaacaagaaaaagcaaaagccgcagccggacccgccggcggaggcggcgacuucgauuaccccggcgcccccgccggccccggcggcgcagucauguccgcaggagcccacggcccaccacccggcuacggcugcgccgccgcaggcuaccuagacggucgacuggaaccccucuacgaacgcgucggcgccccugcacuccgcccccucgucauaaaacaagaaccccgagaagaagacgaagccaaacaacucgcccucgccggccuauuccccuaccaaccacccccaccacccccacccccacacccacacgccucaccagcacaccuugccgcaccccaccuacaauuccaaaucgcccacugcggccaaacaacaaugcaccuacaaccuggccaccccaccccaccucccacacccguccccucaccccauccugcccccgccaugggagcagcaggccuacccggaccaggcggcucccuaaaaggccuagccggcccacaccccgaccuacgaacuggcggaggcggcggaggcggcgcaggcgcaggcaaagccaagaaauccgucgacaaaaacuccaacgaauaucgcguccgccgagaacgcaacaacauagccguccgcaaaucccgugacaaagccaaacaacgaaacguagaaacucaacaaaaaguccucgaacucacauccgacaacgaccgccucagaaaacgcgucgaacaacucucccgagaacucgacacccuccgcggcaucuuccgccaacuccccgaaucaucccucgucaaagcaaugggcaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1361 - RNA, 1382 nt, Artificial Sequence
  mRNA product Design3 comprising derived and/or modified sequence from Rattus norvegicus__NP_036656.1__RnCebpa(15-344) (opt11)
gggagagucccgcagucggcguccagcggcucugcuuguucgugugugugucguugcaggccuuauucaagcuuaccaugucaucccaccuucaauccccaccccacgcccccuccaacgccgcauucggauucccccgaggagccggcccagcaccaccccccgccccaccagccgcccccgaaccccucggcggaauaugcgaacacgaaaccucaaucgacaucucagcguacauagacccagccgccuucaacgacgaauuccuagcggaccucuuccaacacuccagacaacaagaaaaagcaaaagccgccgccggacccgccggagguggaggagacuucgacuaccccggagcccccgccggacccggcggcgcaguaauguccgccggcgcacacggucccccccccggauacggcugcgcugccgccggcuaccuagacggcagacuagaaccacuauacgaacgcgucggcgccccagcccucagaccacuagucaucaaacaagaaccccgagaagaagacgaagcaaaacaacuagcccuagccggccuauuccccuaccaaccaccccccccaccaccccccccccacccccacgcaucccccgcccaccuagccgccccccaccuccaauuccaaauagcccacugcggccaaacaaccaugcaccuacaacccggacaccccacacccccccccacccccguccccucaccccaccccgcacccgccaugggcgccgccggccuccccggacccggcggcucccuaaaaggacuagccgguccccaccccgaccuccgcaccgggggaggaggcggcggcggcgccggagccggcaaagccaaaaaauccguugacaaaaacucaaacgaauacagagucagacgagaacgcaacaacauugccguccgcaaaucacgcgacaaagcaaaacaacgaaacgucgaaacacaacaaaaaguccucgaacucacuuccgacaacgaccgacuacgcaaacgcgucgaacaacucagccgcgaacucgacacacuccgcggcaucuuccgccaacuacccgaauccucccucguaaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1362 - RNA, 1427 nt, Artificial Sequence
  mRNA product Design3 comprising derived and/or modified sequence from Mus musculus__NP_031704.2 __MmCebpa (opt11)
gggagagucccgcagucggcguccagcggcucugcuuguucgugugugugucguugcaggccuuauucaagcuuaccauggaaucagccgacuucuacgaagucgaaccacgccccccaaugucuucccaccuacaaucuccgccccacgcucccucaaacgcagccuucggcuucccacgcggcgccggacccgcccccccacccgccccucccgccgcacccgaaccccucggcggcaucugcgaacacgaaacauccaucgacauaagcgcauacauagaccccgcagcauucaacgacgaauuccucgccgaccucuuccaacacucgcgucaacaagaaaaagcaaaagccgcagccggccccgccggcggcggcggcgacuucgacuaccccggcgcccccgccggucccggaggagccguaaugucggcaggcgcccacggacccccccccggauacggaugcgccgccgccggcuaccuagacggacgccucgaaccccucuacgaaagagucggagcacccgcccuacgcccucucguaaucaaacaagaaccccgcgaagaagacgaagccaaacaacucgcccuagccggacucuuccccuaccaacccccccccccaccacccccaccccacccccacgcaucaccagcccaccuagccgccccccaccuacaauuccaaauagcacacugcggacaaaccaccaugcaccugcaaccaggacacccaacccccccacccaccccaguccccuccccccacgccgcccccgcacucggagccgccggccuacccggccccggcucagcacucaaaggccuugcaggcgcccacccagaccuacguacaggcggaggaggcggcggcuccggcgccggcgccggaaaagccaaaaaauccgucgacaaaaacuccaacgaauaccgcguccgccgcgaacgaaacaacaucgccgucagaaaaucccgcgacaaagcaaaacaacgcaacgucgaaacccaacaaaaaguccuagaauuaaccuccgacaacgacagacuucgcaaacgagucgaacaacuaucacgcgaacucgacacacuccgcggcauauuccgccaacucccagaaucaucccuugucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1363 - RNA, 1385 nt, Artificial Sequence
  mRNA product Design3 comprising derived and/or modified sequence from Mus musculus__NP_031704.2 __MmCebpa(15-359) (opt11)
gggagagucccgcagucggcguccagcggcucugcuuguucgugugugugucguugcaggccuuauucaagcuuaccaugucaucccaccuccaauccccaccccacgccccauccaacgcugccuucggauucccccgcggcgccggccccgcacccccacccgccccccccgcugcaccagaacccuuaggcggaauaugcgaacacgaaaccagcauagacaucucagcauacauugaccccgccgccuucaacgacgaauuccucgccgaccucuuccaacacagccgacaacaagaaaaagcaaaagccgcugcaggccccgccggcggcggcggcgacuucgacuaccccggcgccccagccggcccaggcggcgccgucaugucugcaggcgcccacggccccccacccggauacggaugugccgccgccggcuaucucgacggccgccuagaaccacucuacgaaagaguaggcgcccccgcccuccgcccccucgucaucaaacaagaacccagagaagaagacgaagccaaacaacucgcacucgccggccuguuccccuaccaaccccccccacccccaccccccccccacccacacgccucaccagcccaccucgccgccccccaccuccaauuccaaauagcccacugcggccaaaccaccaugcaccuccaaccgggccaccccaccccccccccaacccccguccccucuccccacgcagccccagcauuaggcgccgccggacuaccaggcccaggaucagcccuaaaaggacuagcaggcgcacaccccgaccuccgcacaggcggaggcggaggcggcagcggagccggcgccggaaaagccaaaaaaucagucgauaaaaacucaaacgaauacagaguccgacgcgaacgcaacaacaucgccguccgcaaaucaagagacaaagcuaaacaacgcaacguggaaacucaacaaaaaguccucgaacucaccucagacaacgaccgccuccgcaaacgcgucgaacaacucuccagagaacucgacacccuccgcggaaucuuucgacaacuccccgaauccucacucguaaaagcaaugggcaauugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1364 - RNA, 1424 nt, Artificial Sequence
  mRNA product Design3 comprising derived and/or modified sequence from Homo sapiens__NP_004355.2__HsCEBPA (opt11)
gggagagucccgcagucggcguccagcggcucugcuuguucgugugugugucguugcaggccuuauucaagcuuaccauggaaagcgcagacuucuacgaagcagaaccccgaccccccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1365 - RNA, 1382 nt, Artificial Sequence
  mRNA product Design3 comprising derived and/or modified sequence from Homo sapiens__NP_004355.2__HsCEBPA(15-358) (opt11)
gggagagucccgcagucggcguccagcggcucugcuuguucgugugugugucguugcaggccuuauucaagcuuaccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1366 - RNA, 1772 nt, Artificial Sequence
  mRNA product Design3 comprising derived and/or modified sequence from Homo sapiens__NP_000448.3__HsHNF4A (opt11)
gggagagucccgcagucggcguccagcggcucugcuuguucgugugugugucguugcaggccuuauucaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgccuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1367 - RNA, 977 nt, Artificial Sequence
  mRNA product Design3 comprising derived and/or modified sequence from Homo sapiens__NP_061986.1__HsFGF21 (opt11)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1368 - RNA, 1703 nt, Artificial Sequence
  mRNA product Design3 comprising derived and/or modified sequence from Homo sapiens__NP_078852.3__HsOGFRL1 (opt11)
gggagagucccgcagucggcguccagcggcucugcuuguucgugugugugucguugcaggccuuauucaagcuuaccaugggcaaccuccuaggcggagucucauuccgcgaacccaccacaguagaagacugcgacuccaccuggcaaacagacuccgaacccgaaccagaggaaccuggacccggcggcggaucggaaggacccggccaagaaagcgagcagcccgcacaaccacccgaacaagccgguggacgcccaggcgccucacccgccccagacgaggacgccgaagccgccggcgcagagcagggcggagacagcacugaagccacagcaaaaccuaaacgcuccuucuacgccgcccgagaccucuacaaauacagacaccaauaccccaacuucaaagacauucgauaccaaaacgaccucuccaaccuccgcuucuacaaaaacaaaaucccauucaaacccgacggagucuacauagaagaaguccucuccaaauggaaaggcgacuacgaaaaacuggaacacaaccacacauacauccaauggcucuuuccccuccgcgaacaaggccucaacuucuacgccaaagaacuaaccacauacgagaucgaagaauuuaaaaaaacuaaagaagccauacgccgcuuccuacucgccuacaaaaugaugcuagaguucuucggcaucaaacucaccgacaaaaccggcaacgucgcccgagccgucaacuggcaagaacgauuccaacaccucaacgaaucccaacacaacuaccuacgcauaacccgcauacuaaaaucccuuggcgaacucggauacgaauccuucaaauccccacuugucaaguucauccuccacgaagcucuagucgaaaacacaauaccaaacauaaaacaguccgcacucgaauacuucgucuacaccauccgcgaccgccgcgagcgccgcaaacuccuccgcuucgcccagaaacacuacacccccuccgaaaacuucaucuggggacccccaagaaaagaacaaucagaaggaucaaaagcucaaaagaugagcuccccacuagccucaucacacaacucccaaaccuccaugcacaaaaaagccaaagacucaaaaaauuccagcucagccguccaccucaacucaaaaaccgcagaggacaaaaaagucgcacccaaagaacccguagaagaaaccgaccgaccaucacccgaaccauccaacgaagcagccaaaccacgcaacacagagaaagacuccaacgccgaaaacaugaacucccaacccgaaaaaacagugaccacacccaccgaaaaaaaagaauccguaucccccgaaaacaacgaggaaggcggaaacgacaaccaagacaacgaaaaccccggcaacaccaacugccaugacgucguccuaguccaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1369 - RNA, 905 nt, Artificial Sequence
  mRNA product Design3 comprising derived and/or modified sequence from Homo sapiens__NP_008842.1__HsRLN1 (opt11)
gggagagucccgcagucggcguccagcggcucugcuuguucgugugugugucguugcaggccuuauucaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgccccccaaaccccccgccccgucgccgagaucguccccuccuucaucaacaaagacaccgaaaccaucaucaucaugcucgaauuuaucgccaaccucccccccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugccuaaucggcugcaccaaacgcucccucgccaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1370 - RNA, 905 nt, Artificial Sequence
  mRNA product Design3 comprising derived and/or modified sequence from Homo sapiens__NP_604390.1__HsRLN2 (opt11)
gggagagucccgcagucggcguccagcggcucugcuuguucgugugugugucguugcaggccuuauucaagcuuaccaugccccgccucuucuucuuccaccuccucggcgucugccuccuccuaaaccaauucucccgagccgucgccgacuccuggauggaagaagucaucaaacuaugcggccgcgaacucguccgcgcccaaaucgccaucugcggcauguccaccugguccaaacgcucccucucccaagaagacgccccccaaaccccccgccccgucgccgaaaucguccccuccuucaucaauaaagacaccgaaaccauaaacaugauguccgaauuugucgcaaaccucccccaagaacucaaacucacccucuccgaaaugcaacccgcccucccccaacuacaacaacacguccccguccucaaagacuccucccuacucuucgaagaauuuaaaaaacucauccgcaaccgccaaucagaagccgccgacuccuccccauccgaacucaaauaccucggccucgacacccacucccgaaaaaaacgccaacucuacagcgcccucgccaacaaaugcugccacgucggcugcaccaaacgcucccucgcccgcuucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1371 - RNA, 776 nt, Artificial Sequence
  mRNA product Design3 comprising derived and/or modified sequence from Homo sapiens__NP_543140.1__HsRLN3  (opt11)
gggagagucccgcagucggcguccagcggcucugcuuguucgugugugugucguugcaggccuuauucaagcuuaccauggcgcgcuauauguugcuauugcucuuggccgugugggugcucacgggcgagcucuggcccggggccgaggccagggccgcgcccuauggcgugcgcuugugcgggcgcgaguucauacgagcggucauauucacgugcgggggcucgcgcuggcgcaggagcgauauauuggcccaugaagcgaugggggacacguucccggacgcggacgcggacgaggacucgcucgcgggcgagcucgaugaagcgauggggagcucggaauggcuagcgcuaacgaaaucgccccaggccuuuuacaggggcaggcccucguggcagggaacgcccgggguauugcgagggagcagggacgugcucgcgggcuugagcucaagcuguugcaagugggggugcucgaaaucggaaauaagcucgcucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1372 - RNA, 1757 nt, Artificial Sequence
  mRNA product Design3 comprising derived and/or modified sequence from Homo sapiens__NP_002412.1__HsMMP1 (opt11)
gggagagucccgcagucggcguccagcggcucugcuuguucgugugugugucguugcaggccuuauucaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1373 - RNA, 1517 nt, Artificial Sequence
  mRNA product Design3 comprising derived and/or modified sequence from Homo sapiens__NP_002412.1__HsMMP1(1-19,100-469) (opt11)
gggagagucccgcagucggcguccagcggcucugcuuguucgugugugugucguugcaggccuuauucaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1374 - RNA, 3704 nt, Artificial Sequence
  mRNA product Design3 comprising derived and/or modified sequence from Clostridium histolyticum__BAA77453.1__ColG (opt11)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1375 - RNA, 3428 nt, Artificial Sequence
  mRNA product Design3 comprising derived and/or modified sequence from Clostridium histolyticum__BAA77453.1__HsALB(1-18)_ColG(111-1118) (opt11)
gggagagucccgcagucggcguccagcggcucugcuuguucgugugugugucguugcaggccuuauucaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1376 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt11)
gggagagucccgcagucggcguccagcggcucugcuuguucgugugugugucguugcaggccuuauucaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1377 - RNA, 3452 nt, Artificial Sequence; identical to SEQ ID NO: 1152
  mRNA product Design3 comprising derived and/or modified sequence from Clostridium histolyticum__BAA34542.1__ColH (opt11)

SEQ ID NO: 1378 - RNA, 3413 nt, Artificial Sequence
  mRNA product Design3 comprising derived and/or modified sequence from Clostridium histolyticum__BAA34542.1__ColH (opt11)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1379 - RNA, 3347 nt, Artificial Sequence
  mRNA product Design3 comprising derived and/or modified sequence from Clostridium histolyticum__BAA34542.1__HsALB(1-18)_ColH(41-1021) (opt11)
gggagagucccgcagucggcguccagcggcucugcuuguucgugugugugucguugcaggccuuauucaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1380 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt11)
gggagagucccgcagucggcguccagcggcucugcuuguucgugugugugucguugcaggccuuauucaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1381 - RNA, 1193 nt, Artificial Sequence
  mRNA product Design3 comprising derived and/or modified sequence from Homo sapiens__NP_003801.1__HsTNFSF10 (opt12)
gggagagucccgcagucggcguccagcggcucugcuuguucgugugugugucguugcaggccuuauucaagcuuaccauggcaaugauggaaguacaaggaggacccagccuaggacaaacaugcguacuaauaguaauauucacaguacuacuacaaucacuuugcguugcaguaacauacguauacuucacaaacgaacuaaaacaaaugcaagacaaauacucaaaaucaggaauagcaugcuucuuaaaagaagaugacucuuacugggacccaaacgacgaagaaagcaugaauagccccugcuggcaaguaaaauggcaacuaagacaacucguacgaaaaaugauacuacgaacaucagaagaaacaauaucaacaguacaagaaaaacaacaaaacauauccccauuaguaagagaaagaggaccacaaagaguagcagcacacauaacaggaacaagaggaagaucaaacacacuaucaaguccaaacaguaaaaacgaaaaagcacuaggaagaaaaauaaacagcugggaaaguaguagaucaggacacucauuccuaucaaaccuacaccuaagaaacggagaauuaguaauccaugaaaaaggauucuacuacauauacucacaaacauauuucagauuccaagaagaaauaaaagaaaauacuaaaaacgacaaacaaaugguccaauauauauacaaauauacaucauacccagacccaauacuacuaaugaaaucagcaagaaacucaugcuggucaaaagaugcagaauauggacuauacucaauauaccaaggaggaauauucgaacuaaaagaaaaugacagaauauuuguaucaguaacaaacgaacaccuaauagacauggaccacgaagcaucauuuuucggcgccuuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1382 - RNA, 914 nt, Artificial Sequence
  mRNA product Design3 comprising derived and/or modified sequence from Homo sapiens__NP_003801.1__HsTNFSF10(95-281) (opt12)
gggagagucccgcagucggcguccagcggcucugcuuguucgugugugugucguugcaggccuuauucaagcuuaccaugacaucagaagaaacaauaagcacaguacaagaaaaacaacaaaacauaucaccacuuguaagagaaagaggaccacaaagaguagcagcacacauaacaggaacaagaggaagaucaaacacacuaagcucaccaaacucaaaaaacgaaaaagcacuaggaagaaaaauaaacucaugggaaucaagcagaucaggacacucauuccuaucaaaccuacaccuaagaaacggagaacuuguaauacacgaaaaaggauucuacuacauauacucacaaacauacuucagauuccaagaagaaauaaaagaaaacacaaaaaacgacaaacaaaugguacaauacauauacaaauacacaucauacccagacccaauacuacuaaugaaaagcgcaagaaacagcuguuggucaaaagaugcagaauacggacuauacucaauauaccaaggaggaaucuucgaauuaaaagaaaacgacagaauauucguaucaguaacaaacgaacaccuaauagacauggaccacgaagcaucauucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1383 - RNA, 965 nt, Artificial Sequence
  mRNA product Design3 comprising derived and/or modified sequence from Homo sapiens__NP_003801.1__HsALB(1-18)_HsTNFSF10(95-281) (opt12)
gggagagucccgcagucggcguccagcggcucugcuuguucgugugugugucguugcaggccuuauucaagcuuaccaugaaauggguaacauucauaucacuacuauuccuauucucaagcgcauacucaacaucagaagaaacaauaucaacaguacaagaaaaacaacaaaacauaucaccauuaguaagagaaagaggaccacaaagaguagcagcacacauaacaggaacaagaggaagaagcaacacacuaagcucaccaaacaguaaaaacgaaaaagcacuaggaagaaaaauaaacucaugggaaucaucaagaucaggacacucauuccuaucaaaccuacaccuaagaaacggagaauuaguaauacacgaaaaaggauucuacuauauauacucacaaacauacuucagauuccaagaagaaauaaaagaaaacaccaaaaacgacaaacaaaugguacaauacauauacaaauacacaucauacccagacccaauacuacuaaugaaaagcgcaagaaacucaugcuggucaaaagacgcagaauacggacuauacagcauauaccaaggaggaauauucgaacuaaaagaaaacgacagaauauucguaucagucacaaacgaacacuuaauagacauggaccacgaagcaucauucuucggagcauucuuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1384 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt12)
gggagagucccgcagucggcguccagcggcucugcuuguucgugugugugucguugcaggccuuauucaagcuuaccaugaaauggguaacauucauaucgcuacuauucuuauucucaagcgcauacucaagaaugaaacaaauagaagacaaaauagaagaaauacucucaaaaauauaccauaucgaaaacgaaauagcaagaauaaaaaaacuaauaggcgaaacuucagaagaaacaauaagcacaguacaagaaaaacaacaaaacauaagcccacuuguaagagaaagaggaccacaaagaguagcagcacauauaacaggaacaagaggaagaagcaacacacuaagcucaccaaacaguaaaaacgaaaaagcacuuggacgaaaaauaaauagcugggaaucaucaagaagcggacacucguuccuaagcaaccuacaccuaagaaacggagaacuuguaauacacgaaaaaggauucuacuacauauacucacaaacauauuuuagauuccaagaagaaauaaaagaaaacacaaaaaacgacaaacaaaugguacaauacauauacaaauacacaucauacccagacccaauacuccuaaugaaaagcgcaagaaacagcugcuggucaaaagaugcagaauacggacuauacagcauauaccaaggaggaauauuugaacuaaaagaaaacgauagaauauucguaaguguaacaaacgaacaccuaauagacauggaccacgaagcuagcuucuucggagcauuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1385 - RNA, 1424 nt, Artificial Sequence
  mRNA product Design3 comprising derived and/or modified sequence from Rattus norvegicus__NP_036656.1__RnCebpa (opt12)
gggagagucccgcagucggcguccagcggcucugcuuguucgugugugugucguugcaggccuuauucaagcuuaccauggaaucagcagacuuuuaugaagcugaaccaagaccccccaugucaucccacuuacaaucacccccacaugcuccaucaaacgcagcauuuggauucccaaggggagcaggcccugcaccaccaccagcaccaccagcagcaccagaaccauuaggagguauuugugaacacgaaacaucaauagacauauccgcuuauauagauccagcagcauuuaaugaugaauuucuagcagaucuuuuucaacauaguagacaacaagaaaaagcaaaagcagcagcugguccagcuggaggaggaggagacuucgauuauccaggagcaccugcagggccuggaggagcggucaugagugcaggugcacauggaccaccuccaggauauggaugugcagcagccggauauuuagauggaagacuagaaccauuauaugaaagaguaggcgcaccagcauuaagaccauuaguaauaaaacaagaaccaagagaagaagacgaagcaaaacaauuagcacuagcaggacuauucccauaucaaccuccaccuccaccaccaccaccacacccacaugcaucaccagcacauuuagcagcaccacauuuacaauuucaaauugcacauuguggacaaacaacaaugcauuuacaaccaggacauccaacaccaccaccaacaccaguaccuucaccacauccagcaccagcaaugggcgcagcagguuuaccaggaccaggaggaaguuuaaaaggcuuagcugguccucauccagaccuaagaaccggaggaggaggaggaggaggagcaggagcaggaaaagcaaaaaaaaguguagauaaaaauucaaaugaauauagaguaagaagagaaagaaacaauauagcaguaagaaaaucuagagauaaagcgaaacaaagaaauguagaaacacaacaaaaaguguuagaacuaacaucagacaacgauagauuaagaaaaagaguagaacaauuaucgagagaacuugauacccuacgaggaauauuucgacaauuaccugaaucaucauuaguaaaagcaauggguaauugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1386 - RNA, 1382 nt, Artificial Sequence
  mRNA product Design3 comprising derived and/or modified sequence from Rattus norvegicus__NP_036656.1__RnCebpa(15-344) (opt12)
gggagagucccgcagucggcguccagcggcucugcuuguucgugugugugucguugcaggccuuauucaagcuuaccaugucaucacaucuacaaucaccaccucaugcaccuucaaaugcagccuuuggauucccaagaggagcaggaccagcaccaccaccagcaccaccagcagcaccagaaccauuaggaggaauaugcgaacaugaaacaucaaucgauauauccgcauauauagauccagcagcauucaaugaugaauuuuuagcagauuuauuucaacauagucgacaacaagaaaaagcaaaagcagcagcaggcccagcaggcggcggaggagacuuugauuacccuggagcaccagcuggacccggaggagcaguaaugucagcaggagcacaugguccaccaccaggauauggaugcgcagcagcaggauacuuagauggaagacuagaaccauuauaugaaagaguaggagcaccugcauuaagaccauuaguuaucaaacaagaaccaagagaagaagaugaagcaaaacaauuagcauuagcaggacuauuuccauaucaaccaccaccaccaccaccaccaccacauccacaugcaucaccagcucaucuagcagcaccucauuuacaauuucaaauagcacauuguggucaaacaacaaugcaucuacaaccaggacauccaacaccaccaccaacuccaguuccaucaccacauccagcaccagcaaugggagcagcaggacuaccaggaccaggaggaucauuaaaaggacuagcaggaccacauccugaucuaaggacaggcggcggaggaggaggaggugcaggagcuggaaaagcuaaaaaaucaguagauaaaaauucaaacgaauauagaguaagacgcgaaagaaauaauauugcgguacgaaaaucaagagauaaagcaaaacaacgaaauguagaaacacaacaaaaaguacuagaauuaacaagugauaacgaccgucuaagaaaaagaguagaacaacuaucaagagaauuagauacucuaagagguaucuuuagacaacuaccagaaucaucauuaguuaaagcaaugggaaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1387 - RNA, 1427 nt, Artificial Sequence
  mRNA product Design3 comprising derived and/or modified sequence from Mus musculus__NP_031704.2 __MmCebpa (opt12)
gggagagucccgcagucggcguccagcggcucugcuuguucgugugugugucguugcaggccuuauucaagcuuaccauggaaucagcagacuuuuaugaaguagaaccuagaccaccaaugaguucacauuuacaaucaccaccacaugcuccaucaaaugcagccuuuggauuuccuagaggagcaggaccagcaccaccaccagcuccaccagcugcaccagaaccauuaggaggaauaugugaacaugaaacaucaauagauauaucagcauacauagacccagcugcauuuaaugacgaauuucuagcugaucuuuuccaacacucaagacaacaagaaaaagcaaaagcagcagcuggaccagcaggaggaggaggagauuuugauuauccuggagcaccagcaggaccuggaggagcaguaaugucagcuggugcacauggaccuccaccaggauacgguugugcagcagcaggcuacuuagacggacgauuagaaccauuauacgaaagaguaggcgcuccagcacuuagaccuuuagucauuaaacaggaaccaagagaagaagaugaagcaaaacaacuagcuuuagcaggacuauuuccauaucaaccacccccaccaccaccaccuccacacccacaugcaucaccugcacaucuagcugcaccacauuuacaauuccaaauagcacauuguggucaaacaaccaugcauuuacaacccggacauccaaccccaccuccaacacccguuccuucuccacaugcagcaccagcacuaggagcagcagguuuaccaggacccggaagugcauuaaaaggauuagcaggagcacauccagauuuaagaacuggcgguggugguggaggaaguggagcuggugcaggaaaagccaaaaaaucaguagauaaaaauucuaacgaauauagaguaagaagagaaagaaauaauauugcuguaagaaaaucaagagauaaagccaaacaaagaaauguagaaacacaacaaaaaguauuagaauuaacaagcgauaaugauagguuaagaaaaagaguagaacaacugucuagagaauuagauacauuaagaggaauauuuagacaacuaccagaauccucacuaguaaaagcaaugggcaauugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1388 - RNA, 1385 nt, Artificial Sequence
  mRNA product Design3 comprising derived and/or modified sequence from Mus musculus__NP_031704.2 __MmCebpa(15-359) (opt12)
gggagagucccgcagucggcguccagcggcucugcuuguucgugugugugucguugcaggccuuauucaagcuuaccaugaguagccacuuacaaucaccaccacaugcaccaucaaaugccgcauuuggauucccacgaggugcagguccagcaccaccuccagcaccaccagcagcaccagaaccauuaggaggaauuugugaacaugaaacaucaauagauauuucagcauauauagauccugcagcauuuaaugaugaauuuuuagcagauuuauuucaacauaguagacaacaagaaaaagcaaaagcagcugcuggcccagcaggaggaggcggagauuucgauuauccuggagcaccagcaggaccuggaggagcaguaaugagugcaggugcacacggaccacccccaggauauggaugugcagcagcaggauacuuagaugguagauuagaaccauuauaugaaaggguaggugcaccagcacuaagaccauuaguaauaaaacaagaaccaagagaagaagacgaagcaaaacaauuagcauuagcuggauuauuucccuaccaaccacccccaccaccaccuccaccacacccacaugcuucaccagcucauuuagcagcaccucauuuacaauuucaaauagcucauugcggacaaacaacaaugcaucuacaaccaggacauccaacaccaccuccaacaccaguaccaucaccucaugcugcaccagcacuaggugcagcuggauuacccggaccaggaucagcauuaaaaggauuagcaggagcucauccagauuuaagaacagguggaggagguggugguucuggagcaggagcagguaaagcaaaaaaaaguguagauaaaaauaguaacgaauacagaguaagaagagaacgaaauaauauagcaguuagaaaaucaagagauaaagcaaaacaaagaaauguagaaacacaacaaaaaguccuagaauuaacaucagauaaugacagauuaagaaaaagaguagaacaauuaucacgagaacuugauacauuaagaggaauauuuagacaauuaccugaauccucucuaguaaaagcaaugggaaauugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1389 - RNA, 1424 nt, Artificial Sequence
  mRNA product Design3 comprising derived and/or modified sequence from Homo sapiens__NP_004355.2__HsCEBPA (opt12)
gggagagucccgcagucggcguccagcggcucugcuuguucgugugugugucguugcaggccuuauucaagcuuaccauggaaagcgcugauuuuuaugaagcagaaccaagaccaccaaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1390 - RNA, 1382 nt, Artificial Sequence
  mRNA product Design3 comprising derived and/or modified sequence from Homo sapiens__NP_004355.2__HsCEBPA(15-358) (opt12)
gggagagucccgcagucggcguccagcggcucugcuuguucgugugugugucguugcaggccuuauucaagcuuaccaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1391 - RNA, 1772 nt, Artificial Sequence
  mRNA product Design3 comprising derived and/or modified sequence from Homo sapiens__NP_000448.3__HsHNF4A (opt12)
gggagagucccgcagucggcguccagcggcucugcuuguucgugugugugucguugcaggccuuauucaagcuuaccaugagacuaucaaaaacauuagucgacauggauauggcagacuacuccgcugcauuagauccagcauacacaacacuugaauuugaaaacguacaaguacuaacgaugggaaacgacaccucaccaagcgaaggaaccaauuuaaacgcacccaauucauuaggaguuucagcauuaugcgcaauaugcggagauagagcaacagggaaacauuauggagccucaaguugcgacggauguaaagguuucuucagaagaucaguaagaaaaaaccacauguacucaugcagauuuucuagacaaugcguaguagacaaagauaaacgaaaucaaugcagauauuguagauuaaaaaaauguuucagagcaggaaugaaaaaagaagcuguccaaaaugaacgagaucgaauaagcacacgacgauccucauaugaagauucaucacuaccauccauaaacgcauuacuacaagcagaagucuuaucaagacaaauaacaucaccaguaucaggaaucaacggagauauaagagcaaaaaaaauugcaucaauagcagauguaugcgaaucaaugaaagaacaauuacuuguccuuguagaaugggccaaauacauaccagcauuuugugaacuaccacuagacgaucaaguagcauuauuaagagcacacgccggagaacacuuauuacucggagcaacaaaaagauccaugguauuuaaagacguacuuuuacuaggcaaugauuacauaguaccucgucacuguccagaacuagcagaaaugucacgaguaucaauaagaauccuagaugaacuuguacuaccauuccaagaauuacaaauagacgacaacgaauacgcauaccucaaagcuauaauauucuuugacccagacgcaaaaggcuuaucugauccaggaaaaaucaaaagauuaagaucacaaguacaaguaucauuagaagacuacauaaacgauagacaauacgauucaagaggcagauuuggagaacuauuauuacuacuacccacacuacaaucuauaacauggcaaaugauugagcaaauacaguuuauaaaacuauucggaauggcaaaaauagacaaccuauuacaagaaaugcuacuaggaggcucaccaagugaugccccccacgcacaccauccacuccacccacaccucaugcaagaacacaugggaacaaauguuauaguagcaaacacuaugccaacccacuuaucuaauggacaaaugugcgaauggccaagaccacguggucaagcagcgacaccugaaacaccacaaccaaguccaccaggcgguucaggaucagaacccuauaaauuauuacccggagccguagcaacaauaguaaaaccacuaucugcuauaccacaaccaacaauaacaaaacaagaaguaauauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1392 - RNA, 977 nt, Artificial Sequence
  mRNA product Design3 comprising derived and/or modified sequence from Homo sapiens__NP_061986.1__HsFGF21 (opt12)
gggagagucccgcagucggcguccagcggcucugcuuguucgugugugugucguugcaggccuuauucaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1393 - RNA, 1703 nt, Artificial Sequence
  mRNA product Design3 comprising derived and/or modified sequence from Homo sapiens__NP_078852.3__HsOGFRL1 (opt12)
gggagagucccgcagucggcguccagcggcucugcuuguucgugugugugucguugcaggccuuauucaagcuuaccaugggaaacuuauuaggaggaguaucauuccgagaaccuacgaccguugaagacugcgacucaacauggcaaacagacucugaaccagaaccagaagaaccuggaccaggcggaggaagcgaaggcccaggacaagaauccgaacaaccagcacaaccaccagaacaagcaggaggaagaccuggagcaucgcccgccccagaugaagacgcagaagccgcaggagcagaacaaggaggcgacuccacagaagccacagcaaaaccaaaacgaucauucuacgcugcacgcgaucuauacaaauauagacaccaauauccaaacuucaaagauauaagauaccaaaaugacuuaagcaacuuacgguucuacaaaaacaaaaucccauuuaaaccagacggaguauacauagaagaaguacuaucaaaauggaaaggagacuacgaaaaacuagaacacaaccacacauacauacaaugguuauucccuuuaagagaacaaggacucaauuucuaugcaaaagaacuaaccacauacgaaauugaagaauuuaaaaaaacaaaagaagcaaucagaagauucuuacuagcauacaaaaugaugcuagaauuuuuuggaauaaaacucacagacaaaacaggaaacguagccagagcaguuaacuggcaagaacgcuuucaacaucuaaacgaaucacaacacaacuaucucagaauaacaagaauacuaaaaucacugggagaauuaggcuacgaaucauuuaaaucaccacuuguaaaauucauauuacacgaagcacucguagaaaacacaauaccaaauauaaaacaaucugcccucgaauauuuugucuacaccaucagagauagacgcgaaagaagaaaauuauuacgauucgcacaaaaacauuacacaccaucagaaaacuucauauggggaccaccaagaaaagaacaauccgaaggaaguaaagcacaaaaaaugucaucaccacuagcauccucacacaacagucaaacaagcaugcacaaaaaagcaaaagacagcaaaaacucaucaagugcaguacaccuaaacucaaaaacagcagaagauaaaaaaguagcuccuaaagaaccgguugaagaaacagaucgaccaucaccagaaccaagcaacgaagcagcaaaaccuagaaacacagaaaaagacucaaaugcagaaaacaugaauagccaaccugaaaaaacaguaaccacaccaacagaaaaaaaagaaaguguaaguccagaaaacaaugaagaaggagguaacgacaaucaagauaacgaaaacccaggcaauaccaacugucaugacguaguucuaguacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1394 - RNA, 905 nt, Artificial Sequence
  mRNA product Design3 comprising derived and/or modified sequence from Homo sapiens__NP_008842.1__HsRLN1 (opt12)
gggagagucccgcagucggcguccagcggcucugcuuguucgugugugugucguugcaggccuuauucaagcuuaccaugccaagacuauucuuauuccacuuacuagaauuuugccuacuacuaaaccaauucucaagagcagucgcagcaaaauggaaagacgacguaauaaaacuaugcggaagagaacuuguaagagcacaaauagcaauaugcggaauguccacauggucaaaaagaucacuaucacaagaagacgcaccacaaacaccaagaccaguagcagaaauaguaccuagcuucauaaacaaagacacagaaacaauaauaauaauguuagaauuuauagccaaccuaccacccgaacuaaaagcagcauuaagcgaaagacaaccaucauuaccagaauuacaacaauacguaccagcacuaaaagacucaaaccuaucauucgaagaauuuaaaaaauuaauaagaaacagacaaucagaagcagcagauucaaacccaucagaacuaaaauaccuaggacuagacacacacucacaaaaaaaaagaagaccauacguagcacuauucgaaaaaugcugccuaauaggaugcacaaaacgaucauuagcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1395 - RNA, 905 nt, Artificial Sequence
  mRNA product Design3 comprising derived and/or modified sequence from Homo sapiens__NP_604390.1__HsRLN2 (opt12)
gggagagucccgcagucggcguccagcggcucugcuuguucgugugugugucguugcaggccuuauucaagcuuaccaugccaagacuauucuucuuccacuuacuaggaguaugcuuacuacuaaaccaauucucaagagcaguagcagacucauggauggaagaaguaauaaaacuaugcggcagagaacuuguaagagcacaaauagcaauaugcggaaugucaaccuggucaaaaagaucacuaucacaagaagacgcaccacaaacaccacgaccaguagcagaaauaguaccaucauucauaaacaaagacacagaaacaauaaacaugaugucagaauuuguagcaaacuuaccccaagaacuaaaauuaacauuaucagaaaugcaaccagcacuaccacaacuacaacaacacguaccaguacuaaaagacucaucacuacuauucgaagaauuuaaaaaacuaauaagaaacagacaaucagaagcagcagacucaucaccaucagaauuaaaauaccuaggacuagacacacacagcagaaaaaaacgacaacuauacagcgcacuagcaaacaaaugcugccacguaggaugcacaaaaagaucacuagcaagauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1396 - RNA, 776 nt, Artificial Sequence
  mRNA product Design3 comprising derived and/or modified sequence from Homo sapiens__NP_543140.1__HsRLN3  (opt12)
gggagagucccgcagucggcguccagcggcucugcuuguucgugugugugucguugcaggccuuauucaagcuuaccauggcaagguauauguuauuauuauuacuagcaguauggguauuaacaggagaauuauggccaggagcagaagcaagagcagcaccauauggagugagauuauguggaagagaauuuauaagagcaguaauauuuacauguggaggaaguagauggagaagaagugauauauuagcacaugaagcaaugggagauacauuuccagaugcagaugcagaugaagauucauuagcaggagaauuagaugaagcaaugggaaguagugaaugguuagcauuaacaaaaagcccacaagcauuuuauagaggaagaccaaguuggcaaggaacaccaggaguauuaagaggaaguagagauguauuagcaggauuaaguaguaguuguuguaaauggggauguaguaaaagugaaauaaguaguuuauguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1397 - RNA, 1757 nt, Artificial Sequence
  mRNA product Design3 comprising derived and/or modified sequence from Homo sapiens__NP_002412.1__HsMMP1 (opt12)
gggagagucccgcagucggcguccagcggcucugcuuguucgugugugugucguugcaggccuuauucaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1398 - RNA, 1517 nt, Artificial Sequence
  mRNA product Design3 comprising derived and/or modified sequence from Homo sapiens__NP_002412.1__HsMMP1(1-19,100-469) (opt12)
gggagagucccgcagucggcguccagcggcucugcuuguucgugugugugucguugcaggccuuauucaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1399 - RNA, 3704 nt, Artificial Sequence
  mRNA product Design3 comprising derived and/or modified sequence from Clostridium histolyticum__BAA77453.1__ColG (opt12)
gggagagucccgcagucggcguccagcggcucugcuuguucgugugugugucguugcaggccuuauucaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1400 - RNA, 3428 nt, Artificial Sequence
  mRNA product Design3 comprising derived and/or modified sequence from Clostridium histolyticum__BAA77453.1__HsALB(1-18)_ColG(111-1118) (opt12)
gggagagucccgcagucggcguccagcggcucugcuuguucgugugugugucguugcaggccuuauucaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1401 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt12)
gggagagucccgcagucggcguccagcggcucugcuuguucgugugugugucguugcaggccuuauucaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1402 - RNA, 3452 nt, Artificial Sequence
  mRNA product Design3 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1403 - RNA, 3413 nt, Artificial Sequence
  mRNA product Design3 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1404 - RNA, 3347 nt, Artificial Sequence
  mRNA product Design3 comprising derived and/or modified sequence from Clostridium histolyticum__BAA34542.1__HsALB(1-18)_ColH(41-1021) (opt12)
gggagagucccgcagucggcguccagcggcucugcuuguucgugugugugucguugcaggccuuauucaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1405 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt12)
gggagagucccgcagucggcguccagcggcucugcuuguucgugugugugucguugcaggccuuauucaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1406 - RNA, 1193 nt, Artificial Sequence
  mRNA product Design3 comprising derived and/or modified sequence from Homo sapiens__NP_003801.1__HsTNFSF10 (opt13)
gggagagucccgcagucggcguccagcggcucugcuuguucgugugugugucguugcaggccuuauucaagcuuaccauggcaaugauggaaguccaaggaggacccucacuaggacaaacaugcguacuaauaguaauauucacaguacuacuacaaucacuaugcguagcaguaacauacgucuacuuuacaaacgaacuuaaacaaaugcaagauaaauacucaaaaucaggaauagcaugcuucuuaaaagaagaugacucauacugggacccaaacgacgaagaaucaaugaauagcccaugcuggcaaguaaaauggcaacuaagacaacuuguaagaaaaaugauacuaagaacaucagaagaaacaauaucaacaguacaagaaaaacaacaaaacauaucaccauuaguaagagaaagaggcccacaacgcguagcagcacacauaacaggaacaagaggaagaucaaacacacuaucaucaccaaauucaaaaaaugaaaaagcauuaggacgaaaaaucaacucaugggaaucaucaagaucaggacauucauucuuaaguaaucuacacuuacgaaacggagaauuaguaauacacgaaaaaggauucuacuacauauacucacaaacauacuucagauuccaagaagaaauaaaagaaaacacaaaaaacgacaaacaaaugguacaauacauauauaaauauacaagcuacccagacccaauauuauuaaugaaaagugcaagaaauagcugcuggucaaaagacgcagaauauggacuauacucaauauaccaaggaggaauauucgaacuaaaagaaaacgaccgaauauucguaucaguaacaaacgaacaccuaauagacauggaccacgaagcaucauucuucggagcauuccucgucggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1407 - RNA, 914 nt, Artificial Sequence
  mRNA product Design3 comprising derived and/or modified sequence from Homo sapiens__NP_003801.1__HsTNFSF10(95-281) (opt13)
gggagagucccgcagucggcguccagcggcucugcuuguucgugugugugucguugcaggccuuauucaagcuuaccaugacaucagaagaaacaauaucaacaguacaagaaaaacaacaaaacauaucaccccuaguaagagaaagaggaccacaacgaguagcagcacacauaacaggaacaagaggacgaucaaacacacuaucaucaccaaacuccaaaaacgaaaaagcacuaggaagaaaaauaaacucaugggaaucaucaagaagcggacacucauuucuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaucuuacccagacccaauacuacuaaugaaaucagcaagaaacagcugcuggucaaaagacgcagaauacggacuauacucaauauaccaagguggaauauucgaacuaaaagaaaacgacagaauauucguaucaguaacaaacgaacacuuaauagacauggaccacgaagcaucauucuucggagcauucuuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1408 - RNA, 965 nt, Artificial Sequence
  mRNA product Design3 comprising derived and/or modified sequence from Homo sapiens__NP_003801.1__HsALB(1-18)_HsTNFSF10(95-281) (opt13)
gggagagucccgcagucggcguccagcggcucugcuuguucgugugugugucguugcaggccuuauucaagcuuaccaugaaauggguaacauucauaucacuacuauuccuauucucaucagcauacucaacaucagaagaaacaauaagcacaguacaagaaaaacaacaaaacauaucaccacucguaagagaaagaggaccacaaagaguagcagcacacauaacaggaacaagaggacgaucaaacacacuaucaucaccaaacagcaaaaacgaaaaagcacuaggaagaaaaaucaauucaugggaauccucaagaucaggacacucauuccuauccaaccuacaccuaagaaacggagaauuagucauacacgaaaaaggauucuacuacauauacucacaaacauacuucagauuccaagaagaaauaaaagaaaacaccaaaaacgacaaacaaaugguacaauacauauacaaauacacaucauacccagacccaauacuacuaaugaaaucagcaagaaacaguugcuggucaaaagacgcagaauacggacuauacucaauauaccaaggaggaauauucgaacuaaaagaaaacgacagaauauucguaucaguaacaaacgaacaccuaauagauauggaccacgaagcaucauucuucggagccuuccuaguaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1409 - RNA, 1061 nt, Artificial Sequence
  mRNA product Design3 comprising derived and/or modified sequence from Homo sapiens__NP_003801.1__HsALB(1-18)_ILZ_HsTNFSF10(95-281) (opt13)
gggagagucccgcagucggcguccagcggcucugcuuguucgugugugugucguugcaggccuuauucaagcuuaccaugaaauggguaacauuuauaucacuauuauuccuauucucaagcgcauacucaagaaugaaacaaauagaagacaaaauagaagaaauacuaucaaaaauauaccacauagaaaacgaaauagcacgaauaaaaaaacuaauaggagaaacaucagaagaaaccauaagcacaguacaagaaaaacaacaaaacauaagcccacuuguaagagaaagaggaccacaaagaguagcagcacacauaacaggaacaagaggaagauccaacacauuaucauccccaaacucaaaaaacgaaaaagcacuaggacgaaaaauaaacagcugggaaucaagcagaucaggacacucauuccuaagcaaccuacaccuaagaaacggagaauuaguaauacacgaaaaaggauucuacuacauauacucccaaacauacuuccgauuccaagaagaaauaaaagaaaacacaaaaaacgacaaacaaaugguacaauacauauacaaauacaccucauacccagacccaauacuacuaaugaaaagcgcaagaaacucaugcuggucaaaagacgcagaauacggacuauacucaauauaccaaggaggaauauucgaauuaaaagaaaacgaucgaauauucguaagcguaacaaacgaacaccuaauagacauggaccaugaagcaucauucuucggagcauuccucguaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1410 - RNA, 1424 nt, Artificial Sequence
  mRNA product Design3 comprising derived and/or modified sequence from Rattus norvegicus__NP_036656.1__RnCebpa (opt13)
gggagagucccgcagucggcguccagcggcucugcuuguucgugugugugucguugcaggccuuauucaagcuuaccauggaaagugcggauuuuuacgaagcagaaccaagaccaccaauguccucucaucuucaaucaccaccucaugcuccaucaaaugcugcauuugguuuuccaagaggagcuggaccagcaccuccaccagcaccucccgcagcaccagaacccuuaggagguauaugcgaacaugaaacaucaauagauauaucagcauacauagauccugcagcauucaaugaugaauuuuuagcagauuuauuucaacauucaagacaacaagaaaaagcuaaagcagcugcaggaccagcagguggaggaggagauuuugacuauccaggugcaccagcaggccccggaggcgcaguaaugagcgccggagcccauggaccaccaccaggauacgguugugcugcagcaggcuauuuagacggaagacuagaaccauuauaugaacgaguaggagcuccagcauuaagaccauuaguaauuaaacaagaaccaagagaagaagaugaagcaaaacaacuagcauuagcaggacuauuuccauaucaaccacccccaccuccaccaccaccacacccacacgcauccccagcacacuuagcagcaccacauuuacaauuucaaauagcacauuguggacaaacaacuaugcauuuacaaccaggacauccaacaccaccaccaacaccuguuccuucaccacacccagcaccagcaaugggagcagcaggauuaccaggaccaggaggaucauuaaaaggauuagcuggaccacauccagaucucagaacaggaggaggaggaggaggaggagcaggagcuggaaaagcaaaaaaaucaguagauaaaaacucaaaugaauauagaguaagaagggaaagaaauaacauagcaguaagaaaaaguagagauaaagcaaaacaaagaaauguagaaacacaacaaaaaguauuagaauuaaccucagauaaugaucgauuaagaaaaagaguagaacaauuaucaagagaauuagauacauuaagagguauuuuuagacaauuaccagaaucuucacuaguaaaagcaaugggaaacugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1411 - RNA, 1382 nt, Artificial Sequence
  mRNA product Design3 comprising derived and/or modified sequence from Rattus norvegicus__NP_036656.1__RnCebpa(15-344) (opt13)
gggagagucccgcagucggcguccagcggcucugcuuguucgugugugugucguugcaggccuuauucaagcuuaccaugucaagccaucuacaaaguccaccacaugcaccaucaaaugccgcauuuggguuuccaagaggagcaggaccagcaccaccaccagcaccaccagccgcuccagaaccauuaggaggaauaugugagcaugaaacaucaauagauauaucagcauauauagauccagcagcauuuaaugaugaauuucuugcagauuuauuucaacauucacgacaacaagaaaaagccaaagcagcagcaggaccagcaggaggaggcggagauuuugauuauccuggagcaccagcaggaccaggaggcgcaguaauguccgcaggagcacacggaccaccaccaggauauggaugugcagcugcaggauauuuagauggacgucuugaaccauuauaugaacgagucggagcuccagcacuaagaccacuaguaauaaaacaagaaccaagagaagaagaugaagcuaaacaacuugcacuagcaggacuauucccauaucaaccaccaccuccaccaccaccaccacacccacaugcaaguccagcccauuuagcagcaccacauuuacaauuucaaauagcccacuguggacaaacaacuaugcauuuacaaccaggacauccuacaccaccaccgacaccuguaccaucaccucauccugcaccagcuaugggagcagcaggauuaccaggaccaggaggaucacuaaaaggauuagcaggaccucauccagaucuaagaacaggagguggagggggaggaggagcaggagcagggaaagcaaaaaaaucaguagauaaaaacucaaaugaauauagaguaagaagagaaagaaauaauauagcaguaagaaaaaguagagauaaagcaaaacaacgaaauguagaaacacaacaaaaaguacuagaauuaacaagcgauaaugacagauuaagaaaaagaguagaacaauuaucaagagaauuagauacacuacgaggaaucuuuagacaacuaccagaaaguaguuuaguuaaagcuaugggaaauugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1412 - RNA, 1427 nt, Artificial Sequence
  mRNA product Design3 comprising derived and/or modified sequence from Mus musculus__NP_031704.2 __MmCebpa (opt13)
gggagagucccgcagucggcguccagcggcucugcuuguucgugugugugucguugcaggccuuauucaagcuuaccauggaaucagcagauuuuuaugaaguugaaccuagaccaccaaugagcucacaucuacaaucaccaccacacgcaccuucuaacgcugcauuuggauuuccacgaggagcaggccccgcaccuccaccagcaccaccagcugcaccagaaccucuuggaggaauaugcgaacacgaaacaaguauagauaucucagcauauauagacccagcagcauucaaugaugaauuuuuagcagacuuauuucaacauucaagacaacaagaaaaagcaaaagcagcagcaggaccagcaggaggaggaggagacuucgauuauccuggagcucccgcagguccuggcggagcaguaaugucagccggagcacauggaccaccuccaggauauggaugugcagcagcuggauauuuagacggaagguuagaaccacuauaugaaagaguaggagcaccagcauuacgaccacuaguuauaaaacaagaaccuagagaagaagacgaagcaaaacaacuagcacuagcagguuuauuuccauaccaaccuccaccaccucccccaccaccucacccacaugcaucaccagcacacuuagcggcaccacauuuacaauuucaaauagcacauuguggacaaacaacaaugcauuuacaaccuggacauccaacaccaccaccaacaccgguaccaucaccucaugcagcaccagcacucggagcagcaggucuaccaggaccaggaucagcuuuaaaaggauuagcaggagcacauccagauuuaagaacagguggagguggaggaggaaguggugcaggagcaggcaaagcaaaaaaaucagucgauaaaaacuccaacgaauacagaguaagaagagaaagaaacaauauagcagugagaaaaaguagagacaaagcaaaacaacgaaauguagaaacacaacaaaaaguauuagaguuaacaucagauaaugaucgauuaagaaaaagaguugaacaauuaucaagagaacuagauacacuaagaggaauauuuagacaauuaccagaaucaucauuaguaaaagcaaugggaaacugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1413 - RNA, 1385 nt, Artificial Sequence
  mRNA product Design3 comprising derived and/or modified sequence from Mus musculus__NP_031704.2 __MmCebpa(15-359) (opt13)
gggagagucccgcagucggcguccagcggcucugcuuguucgugugugugucguugcaggccuuauucaagcuuaccaugagcagucaucuacaaucaccaccacaugcaccuucaaaugcagcauuuggauuuccacgaggagcagguccagcacccccaccagcaccaccagcagcaccugaaccucuagguggaaucugugaacaugaaacaaguauagauaucucagcauauauagauccagcagcauuuaaugaugaauuuuuagcugaucuuuuucaacacucaaggcaacaagaaaaagcaaaagcagcagccggaccagcaggaggaggaggagauuuugauuaucccggagcaccagcaggaccaggcggagcaguaaugucagcuggugcacaugguccgccaccuggauaugggugugcagcagcaggauauuuagauggaagauuagaaccacuauaugaaagagucggugcaccagcauuaagaccccuaguaauaaaacaagaaccaagagaagaagacgaagcaaaacaacuagcauuagcaggccuauuuccauaucaaccaccaccaccaccacccccaccacauccacaugcaucaccagcacaucuagcagcuccacauuuacaauuccaaauagcucauuguggacaaacaacaaugcaucuacaaccuggacacccaacaccaccaccaacuccaguaccaucaccacacgcagcaccagcacuaggagcagcaggccuaccaggaccaggaagugcuuuaaaaggauuagcuggugcacauccagauuuaagaacaggagguggcggaggaggaaguggugcaggagcaggcaaagcaaagaaaagcguagauaaaaauucuaaugaauauagaguaagaagagaaaggaauaauauagcaguacgaaaaucuagagauaaagcaaaacaacgaaauguagaaacacaacaaaaaguucuagaauuaacaucagauaacgauagacuaagaaaaagagucgaacaauuaucaagggaauuagacacauuaagaggcauauucagacaacuuccagaaucaucauuagucaaagcaaugggaaauugugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1414 - RNA, 1424 nt, Artificial Sequence
  mRNA product Design3 comprising derived and/or modified sequence from Homo sapiens__NP_004355.2__HsCEBPA (opt13)
gggagagucccgcagucggcguccagcggcucugcuuguucgugugugugucguugcaggccuuauucaagcuuaccauggaaucugcagauuuuuaugaagcagaaccaagaccaccuauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1415 - RNA, 1382 nt, Artificial Sequence
  mRNA product Design3 comprising derived and/or modified sequence from Homo sapiens__NP_004355.2__HsCEBPA(15-358) (opt13)
gggagagucccgcagucggcguccagcggcucugcuuguucgugugugugucguugcaggccuuauucaagcuuaccauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1416 - RNA, 1772 nt, Artificial Sequence
  mRNA product Design3 comprising derived and/or modified sequence from Homo sapiens__NP_000448.3__HsHNF4A (opt13)
gggagagucccgcagucggcguccagcggcucugcuuguucgugugugugucguugcaggccuuauucaagcuuaccaugagacuaaguaaaacauuaguagacauggacauggccgacuauagugccgcauuagauccagcuuauacaacacuagaauuugaaaacguccaaguauuaacaaugggaaaugacacaucaccaagugaaggcaccaaucuaaaugcaccaaacucacuagguguaucagcccucugcgcaauaugcggagacagagcaacagggaaacacuacggagcaucuucaugugacggauguaaaggcuucuuuagaagaucaguaagaaaaaaccacauguacaguugcagauucagcagacaauguguagucgacaaagauaaaagaaaucaaugcagauauugcagacuaaaaaaauguuuccgagcaggaaugaaaaaagaagcaguacaaaacgaaagagaucguaucucaacaagaagaucaucauacgaagacucaagucuaccaagcauaaacgcacuucuucaagcagaaguacuaagcagacaaauaacaagcccgguaucagguaucaacggagacauaagggcaaaaaaaauagcgucaauagcagacguaugcgaaaguaugaaagaacaauuacuuguccuuguagaaugggcaaaauacauaccugcauuuugcgaauuaccacuagacgaccaaguagcacuauuaagagcacaugcaggagaacaccuucuacuaggagcuacuaaaagaucaaugguauuuaaagacguacuauuacuaggaaaugauuacauaguaccaagacacugcccagaacuugcagaaaugucacgaguaagcauaagaauccuagaugaacuugucuuaccauuccaagaauuacaaauagacgacaacgaauacgcauaucuaaaagcaauaauauuuuucgacccagacgcaaaaggacuaucagauccaggcaaaauuaaacgacuccgaucacaaguucaaguaucucuagaagacuauauaaacgaucgacaauacgauagucgaggacgauucggugaauuauuacuucuuuuaccaacauuacaaucaauaacguggcaaaugauugaacaaauccaauucauaaaauuauucggaauggcaaaaauagacaaucuauuacaagaaaugcuacuuggaggaagcccaucagacgcuccacacgcccaccacccucuacauccacaccuaaugcaagaacacaugggcacuaacguaauaguagcaaacacaaugcccacccaucuaucaaacggacaaaugugcgaauggccaagacccagaggacaagcugcaacaccagaaacaccacaaccaaguccaccaggagguaguggaagugaaccauacaaacuuuuaccaggagcaguagcaacaauaguaaaaccacuaucagcaauuccccaaccaacaauaacaaaacaagaaguaauauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1417 - RNA, 977 nt, Artificial Sequence
  mRNA product Design3 comprising derived and/or modified sequence from Homo sapiens__NP_061986.1__HsFGF21 (opt13)
gggagagucccgcagucggcguccagcggcucugcuuguucgugugugugucguugcaggccuuauucaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1418 - RNA, 1703 nt, Artificial Sequence
  mRNA product Design3 comprising derived and/or modified sequence from Homo sapiens__NP_078852.3__HsOGFRL1 (opt13)
gggagagucccgcagucggcguccagcggcucugcuuguucgugugugugucguugcaggccuuauucaagcuuaccaugggaaaccuacucggcggaguuucauucagagaaccaacaacaguagaagacugcgauaguacauggcagaccgauucagaaccugaaccagaagaaccaggccccgguggaggaagcgaaggcccuggacaagaaucagaacaaccagcacaaccaccagaacaagcaggaggaagaccaggagcaagcccagcaccagacgaagacgcagaagcagcaggagccgaacaaggaggagauagcacugaagcaacagcaaaaccaaaaagaucuuuuuacgcagcacgagacuuauauaaauauagacaccaauacccaaauuucaaagacauaagauaccaaaaugaccuauccaaccuacgcuucuacaaaaauaaaauuccauucaaaccagauggaguauacauagaagaaguacuaagcaaauggaaaggugacuaugaaaaacuagaacauaaccacaccuacauacaauggcuauuuccccuaagagaacaaggauuaaauuucuacgcaaaagaacuuacaaccuacgaaauagaagaauuuaaaaaaaccaaagaagccauaagaagauucuuauuagcauacaagaugauguuagaauuuuucggaauuaaacucacagacaaaacaggcaacguagcacgagccguaaacuggcaagaacgauuccaacacuuaaacgaaagucagcacaacuaccuaagaauaacaagaauauuaaaaaguuuaggagaacuaggcuacgaaucauucaaaucuccacuuguaaaauucauacuacacgaagccuuagucgaaaacacaauaccaaacauaaaacaaucugcacuagaauacuuuguauacacaauaagagacagaagagaaaggagaaaauuacuacgauucgcucaaaaacacuauacaccaucagaaaauuucauauggggccccccaagaaaagaacaaagcgaaggcucaaaagcacaaaaaaugucaaguccacuagcaucaagccauaacucacaaacuucaaugcacaaaaaagccaaagacucaaagaacucaucaucagccguacaccuaaacagcaaaacagcagaagauaaaaaaguugcaccaaaagaaccaguagaagaaacagauagaccaucaccagaaccaucaaacgaagcggcaaaaccaagaaacacugagaaagauagcaacgcagaaaacaugaacagccaaccagaaaaaacaguaacgacaccaacugaaaaaaaagaaucaguaaguccagaaaauaaugaagaaggcggcaacgauaaccaagacaacgaaaauccaggaaauaccaacugccacgacguaguauuaguacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1419 - RNA, 905 nt, Artificial Sequence
  mRNA product Design3 comprising derived and/or modified sequence from Homo sapiens__NP_008842.1__HsRLN1 (opt13)
gggagagucccgcagucggcguccagcggcucugcuuguucgugugugugucguugcaggccuuauucaagcuuaccaugccaagacuauucuuauuccaccuacuagaauuuugcuuacuacuaaaccaauucucaagagcaguagcagcaaaauggaaagacgacguaauaaaacuaugcggaagagaacuuguaagagcacaaauagcaauaugcggaaugucaacauggucaaaaagaucacuaucacaagaagacgccccacaaacaccaagaccaguagcagaaauaguaccaucauucauaaacaaagacacagaaacaauaauaauaaugcuagaauuuauagcaaaccuaccaccagaauuaaaagcagcauuaucagaaagacaaccaucauuaccagaacuacaacaauacguaccagcacuaaaagacucaaaccuaucauucgaagaauuuaaaaaacuaauaagaaacagacaaucagaagcagcagacucaaacccaucagaacuaaaauaccuaggacuagacacacacucacaaaaaaaacgaagaccauacguagcacuauuugaaaaaugcugcuuaauaggaugcacaaaaagaucacuagcaaaauacugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1420 - RNA, 905 nt, Artificial Sequence
  mRNA product Design3 comprising derived and/or modified sequence from Homo sapiens__NP_604390.1__HsRLN2 (opt13)
gggagagucccgcagucggcguccagcggcucugcuuguucgugugugugucguugcaggccuuauucaagcuuaccaugccaagacuauucuuuuuccaccuacuaggcguaugccuccuacuaaaccaauuuucaagagcaguagcagacucauggauggaagaaguaauaaaacuaugcggaagagaacuuguaagagcacaaauagcaauaugcggaaugucaacauggucaaaaagaucauuaucacaagaagacgcaccacaaacaccaagaccaguagcagaaauaguaccaucauucauaaacaaagacacagaaacaaucaauaugaugucagaauuuguagcaaaccucccacaagaacuaaaacuaacacuaucagaaaugcaaccagcacuaccacaauuacaacaacacgucccaguacucaaagacucaucacuauuauucgaagaauuuaaaaaauuaauaagaaacagacaaucagaagcagcagacagcucacccucagaacuaaaauaccuaggacuagacacacacucaagaaaaaaaagacaacuauacucagcacuagccaacaaaugcugccacguaggaugcacaaaaagaucacuagcaagauucugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1421 - RNA, 776 nt, Artificial Sequence
  mRNA product Design3 comprising derived and/or modified sequence from Homo sapiens__NP_543140.1__HsRLN3  (opt13)
gggagagucccgcagucggcguccagcggcucugcuuguucgugugugugucguugcaggccuuauucaagcuuaccauggcaagauauauguuauuauuauuauuagcaguauggguauuaacaggagaauuauggccaggagcagaagcaagagcagcaccauauggaguaagauuauguggaagagaauuuauaagagcaguaauauuuacauguggaggaaguagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaagcauuuuauagaggaagaccaaguuggcaaggaacaccaggaguauuaagaggaaguagagauguauuagcaggauuaaguucaaguuguuguaaauggggauguucaaaaucagaaauaaguucauuauguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1422 - RNA, 1757 nt, Artificial Sequence
  mRNA product Design3 comprising derived and/or modified sequence from Homo sapiens__NP_002412.1__HsMMP1 (opt13)
gggagagucccgcagucggcguccagcggcucugcuuguucgugugugugucguugcaggccuuauucaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1423 - RNA, 1517 nt, Artificial Sequence
  mRNA product Design3 comprising derived and/or modified sequence from Homo sapiens__NP_002412.1__HsMMP1(1-19,100-469) (opt13)
gggagagucccgcagucggcguccagcggcucugcuuguucgugugugugucguugcaggccuuauucaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1424 - RNA, 3704 nt, Artificial Sequence
  mRNA product Design3 comprising derived and/or modified sequence from Clostridium histolyticum__BAA77453.1__ColG (opt13)
gggagagucccgcagucggcguccagcggcucugcuuguucgugugugugucguugcaggccuuauucaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1425 - RNA, 3428 nt, Artificial Sequence
  mRNA product Design3 comprising derived and/or modified sequence from Clostridium histolyticum__BAA77453.1__HsALB(1-18)_ColG(111-1118) (opt13)
gggagagucccgcagucggcguccagcggcucugcuuguucgugugugugucguugcaggccuuauucaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1426 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt13)
gggagagucccgcagucggcguccagcggcucugcuuguucgugugugugucguugcaggccuuauucaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

(The sequence listing continues in the following parts.)

The invention claimed is:

1. A method for treatment of liver fibrosis, the method comprising administering to a patient in need thereof an effective amount of RNA comprising at least one coding sequence, wherein said RNA is formulated a lipid nanoparticle and administered by injection,
   wherein the coding sequence encodes hepatocyte nuclear factor 4 alpha (HNF4A) having a polypeptide sequence at least 95% identical to SEQ ID NO: 14, and wherein the coding sequence comprises a nucleic acid sequence at least 90% identical to the RNA sequence of SEQ ID NO: 169.

2. The method of claim 1, wherein the RNA is an mRNA, a viral RNA or a replicon RNA.

3. The method of claim 1, wherein the RNA does not comprise a chemically modified sugar, a chemically modified backbone or a chemically modified nucleobase.

4. The method of claim 1, wherein the RNA does not comprise a chemically modified nucleoside or nucleotide.

5. The method of claim 1, wherein the RNA is not chemically modified.

6. The method of claim 1, wherein the at least one coding sequence of the RNA comprises a nucleic acid sequence encoding a polypeptide of SEQ ID NO: 14.

7. The method of claim 1, wherein the RNA is mono-, bi-, or multicistronic.

8. The method of claim 1, wherein the RNA is an mRNA.

9. The method of claim 8, wherein the RNA is mRNA comprising from 5' to 3': a 5' Cap; a 5' untranslated regions (UTR); the at least one coding sequence; a 3' UTR and a Poly-A region.

10. The method of claim 8, wherein the RNA is formulated in a lipid nanoparticle comprising a cationic lipid.

11. The method of claim 10, wherein lipid nanoparticle comprises: a cationic lipid, an aggregation reducing agent, a non-cationic lipid and a sterol.

12. The method of claim 11, wherein the aggregation reducing agent comprises a PEG-modified lipid.

13. The method of claim 1, wherein the administering is by intravenous injection.

14. The method of claim 1, wherein the method reduces the level of alanine aminotransferase (ALT) in the patient's serum.

15. The method of claim 1, wherein the RNA comprises at least one chemically modified nucleotide.

16. The method of claim 15, wherein the at least one chemically modified nucleotide comprises a chemically modified uridine.

17. The method of claim 15, wherein the at least one chemically modified nucleotide comprises pseudouridine or 1-methyl-pseudouridine.

* * * * *